United States Patent 7,745,391 (HUMAN THROMBOSPONDIN POLYPEPTIDE) - sequence listing, part 6

SEQ ID NO: 13279 - DNA, 343 bp, Homo sapiens
ctctctaatgagcccatcgcagtacttggtgatgactttttcctggcaagtttcatagaagaaatgagtttggtaaaaactaaattactcctgggtgacctgttagatctcttctgcttattttcatgttgttctcagaatgattactaaggtgatttagttagaaagtatatttaaaataattttatttagtttttgaaaaatttgtttgtggtttcttagcaggggtgtttcactgactgttccaaagcttccagcctgggcacacattatggagctccataatgtgtgcccacaggagtgaggtggtagagtggtgttctaaaaagagcagcagagagag

SEQ ID NO: 13280 - DNA, 499 bp, Homo sapiens
ctctctaatgagcccatcgcagtacttggtgatgactttttcctggcaagtttcatagaagaaatgagtttggtaaaaactaaattactcctgggtgacctgttagatctcttctgcttattttcatgttgttctcagaatgattactaaggtgatttagttagaaagtatatttaaaataattttatttagtttttgaaaaatttgtttgtggtttcttagcaggggtgtttcactgactgttccaaagcttccagcctgggcatggtattttaatggataacaaatcccttcccacctctgttctgtacttcatagcatgatggccacagtgctgacagcacttagcttccagtagtcattcgagagagtggctggcgtctctcttctggaagaaatgggacacatggtcccataccaactgtgcctttgcttagatctgccatcataggaacaagactttaacaaccagcagcagcagcaaaccagcattgaggct

SEQ ID NO: 13281 - DNA, 626 bp, Homo sapiens
tttctcctgaaacagattgatgtctgcagcttggcttgcagactgtgcgggggatgcaaactgaataagatctctgcagtctgaaggcatccaaggagacctgggcaaaatggctggtcaggactgcctgccaagtataactattccctcacttgaatgcgccctagaggcgccagctgtgcttgggctgcagcaccgaccaaggtgaacacacacagcctcctttccacaattttaccgttaagttgctgcatttgcaaaggaaaatcttcattgtcacaaatgatgactgtatctgtctgggctttagattgtgatagggaagagcctctccatctcttttgtatgataagtatacttatcacttattacatgggaaggtgagcggtccagggtcctccctgccattttaggtgagacagcatcccaggagaatgaaaaaaaaaaaaagggaaaaaaaaaaaagcaggatctgggagaatgtcttacctggaggacctggcttttacctgggagatgttgcaacttctcagtgaggaaaaacctgacattagctctcctttgaagacattaaagaaaagcaaaaacaaaacaaaacaaaaacaaacgacaaacaagaaaacaaa

SEQ ID NO: 13282 - DNA, 234 bp, Homo sapiens
caatgaactttcaaaacgtatctcatttgaaagttagaagctaattatactagttatatgttgggatgaaagtagagaagcctagtaccaaatctgctgtcagaaccttatacaaagttggaagtgttctgtaccatcaaatatggtagtccctagccacacgtgactattgagcactgaaattgtggccactgtgactgaggaactgaatttttaaattttattccattttag

SEQ ID NO: 13283 - DNA, 519 bp, Homo sapiens
ttttcaccaagttctttagttaacaaagaatgcttttaaaaatgttattaggccaggtgcggtggctcatggctgtaatcccagcacttcgggaggccgaagtgggtggatcacttgaggtcaggagttcaggaccagcctggccaacatggtgaaaccctgtctctcctaaaaatacaaaaattagctgggtgtggttgcccacactgtaatcccagctactcaggaggctgagacagagcaatcccttgaacctggggagacggaggttgcagtgagccgagatgatgccattgcacttgcagcttggggtgacagagcaagactccatctcaaaaacaaaaatgttgttggatttcttttgaagcattagacaaatgggtagttaattcagaaaggagtttacttactagttgcatatacatgtgtaatacttgacattttcaaaacacacactattttctttgatttccttcacatcttagaagtaccacagctagtatttttcctattttggat

SEQ ID NO: 13284 - DNA, 492 bp, Homo sapiens
tatttacgtgtaaaatcaatgatggctagtatgcatttttggtcaaattttgttttccttaatacgggagagcaaaattttgacagaaaatggttcgctagaattgagcttagattctttttatttttaaagagaaactagaagaatgcttctcttcttgaatgcagtatattgctgtaggagtatcttcgttttggtgcctgtgaaacagttatggaaaatggcaacatgaaaacgagaacaactaatgtctgaaataagtgtttctggatgttgaaaagcatcatatgtgtgtttttatttgacacaatttgctttgcaggttgcatttatgataaacctctttgcacctggttattttatgtcagattcagtaaaataataagtcagttgtctgaccaatcagctttcttccaacacctactttgtgtagatcatggacattgaaaactattaaataggagcctttagttaaggactcaacagaaagga

SEQ ID NO: 13285 - DNA, 458 bp, Homo sapiens
atttggttttggactaaaattctgttttctttagaatgaaatatttcttaattgcttttggcttagtctattcagagtagaaggatagatgttaaggcaggtgtacacagggcagctgtcagaaaaggatgcaggacaagccaaaaggagtaaacttatctgaagaaaatgggggaagcaaggaaacagtggcgttaaaacaaagtaatcatgacaagaaataattaagtactggttagactttttttttcttatgattgtaagaatttttggactcctatctgcttatttaaagcgattattttataaacatagggcaagtgaccttgaagtcttttttttcagtgaaggttttgtgagaatcataggaaataatgtctatgaaagcatttcctacattgtaaagtgctcaaaacatacgttgaaattattaataaaagcaaagatgaattgctgtg

SEQ ID NO: 13286 - DNA, 275 bp, Homo sapiens
aatgaaaataaaaaccaactgcgaaggggcagatggtggggcctggagcttctataattcagggttctttagaaaaagaacacaaaattacagacaaaattaggtgcaagaccatgaaggggctctgcaagtgaggggccctgagctccggtttcctttgctttgtggcaaatctctggttccttagtgtcatctgccagtctcttggaggaattagcccattatcccaaattgccttaaacaaagcaaaacacagcttaaggaatatgcagata

SEQ ID NO: 13287 - DNA, 294 bp, Homo sapiens
ccaccctcaaagactggagggcagcttgccctggacttccttccccagtcaagagtaattagctccttccatcatttcaaggaactgtgctaggccaccacatgctgaataggctctctctagtctttgtaatccaccttctcagatcgatgatagtggctgaataaatattgcaaggaataatagctgagctgtcacctattgacacctgaggacaggagactgtggtagtgccacactgttggcttgtgcaggtggatgaaccggggaatgacgacaaggtcaaattggggc

SEQ ID NO: 13288 - DNA, 377 bp, Homo sapiens
ttgaatggtttaaaaataataaatgccatgacattttaaatggaaatttggcatatttttgagataaatatgattggatacatgtgtgtgccattcttttatctcttcttacttttactgtatctctactttaatgatgacaataatatggctacagacatgaaatggtttatctttcttcttttctttcactctttcatttaaagcatttatattattttttattgatgtcaatgttaacattttggcatccttcccaagtatattgcaagaaatacatcaataaaaacttaaatttaaaaaatatgtagtctggggccagataataatggcatatttctttaaaattaggtataaaggagtacagacgaggtcaa

SEQ ID NO: 13289 - DNA, 482 bp, Homo sapiens
taattccagggaagatcagccttagaagacctagaagaagcaagcgtgaggagttcagagttcggtaaggtcacagcttgccgaggaaatgccaggaggacatcagtgaggaaggtgacaggtagcaggataaaaatataactaccttctccctgtaacaagccacgtctgactgtccatgactgtggcccaagaacgtgagcatcacacaattctcaactagacttccgccaacctcctttctctctcttcaccttccagtgtttctttcattcttctcttctcttttcacataatacaagctttcacagagttactctattacagttgggattagggcacatgaaatttatccaaggaaggtcttctccatgcccaatgagtccatcaaaaaaaaaaagccaggttatgttaatacacattatttgatttatatcacaaatacatttgtcagaaattcaataaatatcatacactgccca

SEQ ID NO: 13290 - DNA, 590 bp, Homo sapiens
aactatgatctgtccaaatccagcctgcagcttgtttatgtatagccagcacactaaaaatgatttttacattttaaatggttggaaaaaaattaaaaggagaataatatttcatgacatttgaaaattatatgaaatccagatttcattgtccataaacaggttttatttgaatacagctcatcagttatttatacattatccataactatttttgctacagtggtacaggtgagcagttgcaacaagatactcaaaggttaacattcttgctttctgactctttctttacaggaaaaaaaaaaattactgacccttgcactgtaagatcaagattaagaagagcagcttttgcttagtactttacaatattttaagacttcattgtgtatttttattatagattgagttaaaggaaagactgatgggaaaaatggatgagtccctaaatcaaattttcatggtgtgacctgattatcatttgaaattattttctataatattgccaagcaaattgtaagaccaactttaggaagttatgttttctgcctgtcaccagattattaacctgttttctttccacacagtca

SEQ ID NO: 13291 - DNA, 438 bp, Homo sapiens
tcatcttgaaattatatatacattttattttcaagtatagtggctgtagtttctataaaaggcaagcagtactgcagtttttgttgttgtttgtgtaaagctgctcgtccctggttttccatggtgctcaaatgttggtactccttaaaatgatctaaaatcacctaccctgctaatgatcttagctatttttaactccaattggacagtttgtttcctcccaatttttcttcctcagaatcttcagttttctaaattcttttcctgatttttcttccaaaatatcaagaatattttataccttaaaataggttgaggccaggcacagtggctcatgcttgtaatcccagcacttttgagaagctgaggctggaggattgcttgaactcacgagttcaagaccagcctgggcaacatgatgaaatcctgtctgtacac

SEQ ID NO: 13292 - DNA, 402 bp, Homo sapiens
ggggcaaactagagggagtctgcagagaaagacatcatctggaaacttttcaaaaagagttaacatggaatagcaacaggtaggggagagctccaacatgttgtgttggtgcccccttctggctgatagagagcagagctggtgaaaaatggttgttggctttccaacagtgtaccttcctaagggcactgaccccaagggggtatcatgaacattcagtgagccttgatgtagtaacagattcacctttcctttgaacaaccagtattcaagggtagtgagattggtattttcctgggctcaagtttggcttcgctcaagttaggcttctctagaccttatgtcttccctcctttacctccttctgacttttgaccgttaaattgtagatggtgagtggaa

SEQ ID NO: 13293 - DNA, 338 bp, Homo sapiens
ggaagttcaaggctgcagtgagctatgatcacgccactgcactccagtttgggcgacagagagagaccttgtctcaaaaatttaaaaaaagcaaatgcatgggccacattcagtgcagagtccactgccctgccaaggtgcagggacccagccgggaagtggcaggtgtgaaccatgactgagtctcccacccctaccccagctgcgggctccaggcttcctccagctgcatggggtggatgggagcccagggatgctggaacaggcccaggcccccggcctctatcagcgcctcagcctctgcaccctgggccaggagcctctgcccagcccggaag

SEQ ID NO: 13294 - DNA, 934 bp, Homo sapiens
tgttgcccacacgcccgaggcgcgctggattggcggagcatggcccaggaggagggtgggagcctgcccgaggtgcgggcgcgggtcagggccgcgcatggcatccccgacctggcccaaaagctccatttctatgaccgctgggctccggactacgaccaggatgtggccaccctgctgtaccgtgcgccccgcctcgcagtggactgcctcacacaagcccttccaggcccgccccacagtgccctgatcctggacgtggcctgtggcacaggcctagtggctgccgagctgcgggctccaggcttcctccagctgcatggggtggatgggagcccagggatgctggaacaggcccaggcccccggcctctatcagcgcctcagcctctgcaccctgggccaggagcctctgcccagcccggaagggaccttcgacgcggtgctgatagtcggtgccctcagtgacggccaggtgccctgcaatgcgatacctgagctacatgtcaccaagccaggtgggctggtgtgtctgaccaccaggaccaactggtccaaccttcaatacaaggaggctctggaggccaccctggacaggctggagcaggctgggatgtgggaaggcctggtggcctggcctgtggaccgcctgtggaccgctgggagctggctacctccgagctggaggtggtatccggcatctctgccaaggatggcttcatctccggcattgtctacctgtaccgaaagtggaaggcgacccaggttgaggaagtgagatccagcccccagcccccagctggcccctgactccatgtggccttagctgggcccatctgctgggcctcctctgcctcccctgtaaaatgggacctccgaaccaaccctgcccctcagaaatgccctgcctattaaatgagctcccagaaaacagt

SEQ ID NO: 13295 - DNA, 556 bp, Homo sapiens
cactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtaggctgggggcctggagtgtctcacttggggggtggggctagcactggccctagcgctgtggtggggagcggtttgcccttcctgctaactccatttcccccacgattcttcaccgctgctcaccaccacactcaaccgtcccttgtgcttgtaacctaatggcct

SEQ ID NO: 13296 - DNA, 667 bp, Homo sapiens
cactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggagttgaggttccccattgactgaaccccctagaggccacagaagcaggagactccactggtccagcccccatagatctgccattcacactacagaacagaggagaggagagggaagaggagaagagagcgaatctggagaaggaaacagaacacgtctagtaccgttcactcccttgcccctcggcatccaccctttccctttgtccaaatgaaaatcaaagtccaggacaggctcggtggctcacgcctgtaatgccagcactttgggaagctgaggtgg

SEQ ID NO: 13297 - DNA, 611 bp, Homo sapiens
cactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggagttgaggttccccattgactgaaccccctagaggccacagaagcaggagactccactggtccagcccccatagatctgccattcacactacagaacagaggagaggagagggaagaggagaagagagcgaatctggagaaggaaacagaacacgtctagtaccgttcactcccttgcccctcggcatccaccctttccctttgtccaaatgaaaatcaaagtcc

SEQ ID NO: 13298 - DNA, 326 bp, Homo sapiens
cactcagcccctcctggggtgcttgtggcctcctatacccacttctgctcctcggacctgtgcaatagtgccagcagcagcagcgttctgctgaactccctccctcctcaagctgcccctgtcccaggagaccggcagtgtcctacctgtgtgcagccccttggaacctgttcaagtggctccccccgaatgacctgccccaggggcgccactcattgttatgatgggtacattcatctctcaggaggtgggctgtccaccaaaatgagcattcagggctgcgtgcccaaccttccagcttgaacaccgacgggatcctctagtcg

SEQ ID NO: 13299 - DNA, 816 bp, Homo sapiens
actgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcgaatagcctcccgaa

SEQ ID NO: 13300 - DNA, 267 bp, Homo sapiens
gcagcatgacagaagtaggtgtgtccaagtcaggtcatgttgaccagaatcacccagcctgtgaggaagtattggtcctgtcttctaaccccaattgtatggaagatttctagccatatatattcatttacacataaattagaaacagtgtggtgaaaccattccctagggcaacacagtataatattgaaattgtgtttttagatgaccattactgaacccatataaacagatacttttaatttccaacagttcatctttaacccc

SEQ ID NO: 13301 - DNA, 486 bp, Homo sapiens
tggaaatttaatactttttcagtagagatggggtcttgccatgttgcctaggctgttctcgagctcctaggctcaagtgattcttccacctcggcctcccaaagtgctagggttaacaggcatgaaccaccgtgcctggcctagactttattgtaactaattgcttattcataactttcagaatgtttcctaaattgtgctatataaaaaatgctgtaacgaagttttgtatgtatggcattttgcacaagtgtgagtgatattgagtcttagtagttctgttttaagctagaatctttagtttcgtttttctgccttatcttctggaccaaagctcttttagccaataaaagtgactgaagctgggcatggtggttcacacctgtaataacagctctttgggagactgaggcccaaggattgcttgaagccaggagttgagaccagcctgaggaacatagtgagatctccatctccaccaaaaaa

SEQ ID NO: 13302 - DNA, 478 bp, Homo sapiens
taaagattacttatatctagttcatacctcctaaaggtaatttgaattgaaatagtgatgcatacaataaggtcattaaagtagaaacagaaaataaaggattataaagccattgatggtaagagcaattgattttgtgaactacaaatcatagatttaactgaatagtttgttgtttatacaaaatagctgttgaaaagtttctgactgactgggtgcagtggcttatgcctataatcccagcacttttggaggccaaggcaggtggatcacttgagaacagcctggccaacatggagaaactctgtttctactaaaaatacaaaaattagccaggcatggtggtgcacgcctgtaatcccagctactccagtgagtcaagagaattggttgaacccaggaggcagaggttgcagtgagctgagatcacaccactgcactccagcctgggtgacggagtgaaactcttgtctcaaaa

SEQ ID NO: 13303 - DNA, 415 bp, Homo sapiens
tagttccatttcaaagcctttgcaatggtatttggttctgttaagcatgatcagcagtcttggagctggcgaggtctatatcccttactcagtgcagttctcaaagtcctttgtatgtcgtacaggatcacatctgtacatacacaccttgtggggtaagcccagaagctcatacacagcttcatgggtttactttcccaagcacttcctccctccctgcaatctccccagcactttctgcttccctcagcttccccttttcaaccttgtagccatgaagctgttgctgtcgctttagtgactcttctctgccacacgcttcctgtgcctttgccttcctctggtgtgattcggcaggaagaccaaagaggggaaaaagaagtcacgggcacccctttgggacctacaatcagag

SEQ ID NO: 13304 - DNA, 1180 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (239)..(239): n is a, c, g, or t
nantnaataaaataaaataaaataaaataaaataaaataaaaatggatggtgtcccataaaaagcactagacatttccatctccatctttgaactatgctataccttccagaagggatgccaactagtacatgaaaactatctagaaacacagataggaccaagcttcccttctctgaattcttacagcatatgtttgaagactgctgtgtttgtaatctctctctgcaactcaaatgntttgaacacttgtgatgcaccacagattcttacagggggataaacatgaatgagatatagattacccttttggggcttatacttcagtagtattttaacttgtagacactcttatagtaagcgacacatgctgttctccatggtaatgtctttatattgtatataacatagctaatgtaatctagcttgagctcaaaggacaccagagctaaagcaagatatgtccctttatatttacttatttctttgtttattgagacagggtctcagcccaccacccaggctggagtgcagtggcaccaccacaacttactgtagattctgcctcttgggctcaggtgatcctcccacctcagcctcccaagcagctcagagtacaggcgcatgtcaccatacctggctaattttttgtattttttatttttttaagtagagacgggttttgccatgttgccaggctggtctcaaactcctgggctcaagtgatcagcctgccttggtttcccaaagtgctggacaagatacattcttacatgagacattttgagcctaatgaagataaggcgtggtttttctgtttaagaacttagtagatgatgtatcaaaatagttgcagctatttaaatgatttgaagcagattttatttagttcacggtgaaaattacagttggaaataatcaagtgaaaataagattggctttgactaaatccagagatagcaaaattttgtactgactgaatattaaaagaataatcaaatattttgaaaaaagttagacctaataaatttaatccaagaaaattgaacttggtagaaatgcccacaagaaaaatgcagaggcagaaggttaaatagtaaaactccatgaaaaaaaatgatgactgaactgaatctctgttgtaaaattgaaacatggaataaataattttatgaagataa

SEQ ID NO: 13305 - DNA, 425 bp, Homo sapiens
ttatatgtgccaaaaatacactgaaaacactaggttggctgagtgtgcaaacaatataatccaaagatttcttgtattaagaatgataaaacctcttatttccatacactgtattgtcccaaatcatcaacctggccctgcggtcctcatgatttattgctctcagctggtaacttggcgaggcagcgggcagagcgtgtcaggccttctgtactcacgcaccagcctttaacgcctgctgctccaaccagcagagcagaaagttgggagggacagtgttgaagcctcggccatctgaggcgttgccatctcgcgctgcctcccccgggagccctctggttccttctcggagtcagcagaagctcctctccctctggcacaggacacatggccctcggagtagaatcagcagaggcagtggctgg

SEQ ID NO: 13306 - DNA, 151 bp, Homo sapiens
cggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacg

SEQ ID NO: 13307 - DNA, 464 bp, Homo sapiens
tctgcagcctggtcatctctctctttgcccagttttggagaaagggttcccagcacccgtcagattctccaaggtgctgcttctttcagaaatctggcgtttctgaagagcttgccacgctgcggtatctaaggggaaggaactatttagtcctcttacacttaaagaaacttaagcccaggccaggcgtggtggctcatgcctgtaatcccagcactttgggaggccgaggaaggtggatcacttgaggtcaggagttcgagaccagcctggccaacatggtgaaaccccgtctctaccaaaaatacatagttagctgggtgtggtggcgggcgcctgtaatcccagctactcgggtggctgaggcaggaaacttgcttgaacccgtgaggcggaggttgcagtgagcagagatggagccactgctctccagcctgggtaacagggagactctgtctcaaaaa

SEQ ID NO: 13308 - DNA, 300 bp, Homo sapiens
ggggagcacagttgctcctgcgctggctgtggctgtgggggaaggaagagccgctccattcctgcgtttgatcaggttgtcacgaggactgagtgagtcaccaggtgtgaggggctttggtgggtgtgtcacagtggcaaagcattcacaccggccaggtccccagctgggagcatgtgcccaggagcctgcggtgtgcagctggtctagccccaccgtggagcagccacgtgggagaggccccgggaacaggcgaggtggctgtgccgttcacacccagagagtcgtcagggcaactgg

SEQ ID NO: 13309 - DNA, 513 bp, Homo sapiens
ggatcacttgagctcaggagttcaagaccagcctgggcaacatagtgagaccctgtccccacaaaaaattgaaaaattaacttggcatggtgttacgcgtgtgtagtcccagctacttgggaggctgaagtgggaggatggtgtgagcatgggagggcaaggctgcagtgagccatgatcacgccactgcactccagcctgggcaacagagtgagaccctgtctcaaaaaataaataaataaaataaaacaaagtgttgccacttagtttgctaaatacagattcctttcttccctattcatgttgaagggggaaaatatttcagttataaatgtgaagagaatccacaagttgtttttgttttgttttgttttgttttgttttgttttgttttgttttgtttttgagacagtctcgctgttgtcacccgggccggactagtctcgaactcctgatcctcccagagtgctggaattacaggcgtgagccactgtgctcagcccgagaatccaa

SEQ ID NO: 13310 - DNA, 996 bp, Homo sapiens
ggcgtgccggggcggggcggggcgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaagagtctcgctctgtcacccaggctggagtacagtggcgctatctcagctcactgcaatgttcaagggattctcctgcctcagcctccatagtaactgggattacaggcacgtgccaccatacccggctaattttgtatttttcgtaaagatggggtttcaccctgttggccag

SEQ ID NO: 13311 - DNA, 848 bp, Homo sapiens
ggtgatttctggagtgtgttgggtttacaacggttgcatttcaggaacatgaatctcctgtgcgtggtatgttgaatctgcccaagaaggagccgtgttgcaaagtggttttgttaactacagtgaagtctgtttccgccacaaagctttcttccttcctataacatcataaaataatatttcctaaacttccctcaagtgtaaaccaacagtgttcttgttgcggaaaaagtgcatccttgttcttaattggaaatctataaaaaagggggcagaatcttagaccacaccaagtaaagaagctaaattgctttctaatgtatatgatctgctttagcatcagctgtgaaaatcagcaattgctcacatgcctaagacgcaaaagaaataagatccaagggaaatccagtagtaggaccaagaagtttagggaagtattcctttcttttgcagtgcccctttgttagtttttgcagaaatgtgtgtttgtggggaaattctgaagacagatacctgcgaacacacacacttaggacagtgggctggaagtgggcttcacactacagtaggtgatggctggctaaagtgtcttcagactaagaggatgttttcgattctgtcaagatagacacttaccttaaactcattcagtaatttttttttttttttgaaacagagtctcgctctgtcacccaggctggagtacagtggcgctatctcagctcactgcaatgttcaagggattctcctgcctcagcctccatagtaactgggattacaggcacgtgccaccatacccggctaattttgtatttttcgtaaagatggggtttcaccctgttggccag

SEQ ID NO: 13312 - DNA, 212 bp, Homo sapiens
gcctctcctgagcagccaggattaactctgcttaggacgtttcagataagggtcaggctggctgctcaggagaggcgacacatttcaaatctccacgagatattctccacacagaaaatcttcttgattctatagagacttaatcatgcctatggctttgaataatcttatgtgatttaaataaattaaatctttatagagaaaaaaaaaat

SEQ ID NO: 13313 - DNA, 1344 bp, Homo sapiens
ggcgtgccggggcggggcggggcgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggtcagccccgggccgcgcgggctcctcgcgttggtgccgagtcggggtcagggcgccgccattgacccggggaggacccggggaaccggagccccgtttacgcccctggggagggaactccccgtgtcccggacccgggcctggcagcgagacgcgcaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaagctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcgtcactgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggccaccgtcaaggccccaggctggtttctgaacttgatattgtgcatccatatggcctccatttgcccacatttt

SEQ ID NO: 13314 - DNA, 638 bp, Homo sapiens
ttagctgggcgtggtagcccatgcctgtagtcccagctactcaggaggctgaggcaggaggatggcttgaactcgggaggaagaggttgcagtgagccaggatcttgccactgcactccatcctgggcaacagagtgagactctgtcaaaaaaaaaaaaaaaaaaaagcaataggcgttaatgtcgtgcctccctctgggtggaaatgaagtaggtgtgtttgtcccgcaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtaatttaactccccccacccacctctgcctcccagccttctccggagttcctcctccagtgcatgcgatgattcaagatccgcttgttaaaagtgcctttcatatcaggacgttctgcccagagtgcctctggctagatgggccaggatgttccctctaatggcagggagggaagagccgaccgcctgcctgttcctctgtagct

SEQ ID NO: 13315 - DNA, 1682 bp, Homo sapiens
ggcgtgccggggcggggcggggcgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcgtcactgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgacccccctgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttatagagaaaaaaaaaat

SEQ ID NO: 13316 - DNA, 1841 bp, Homo sapiens
ggcgtgccggggcggggcggggcgtgccggggcggggcgtagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggtcagccccgggccgcgcgggctcctcgcgttggtgccgagtcggggtcagggcgccgccattgacccggggaggacccggggaaccggagccccgtttacgcccctggggagggaactccccgtgtcccggacccgggcctggcagcgagacgcgcaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcgtcactgagccgtccggtggtgtccctgggcaaagccaccttctacaagcagctgccccaggacctggggacggcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttcaacaggtgacaggctgctttcgtgacttgatattggtgtcatagcatttggcctacattaaaagccacaatttcatggggaaaggacaaaatggagagtgactgaggtgctgacctcagtgcaaggctggtgaaccctgcagcgggccagctatggtgggaagcctggcatttggggtgctccttgcaacgtcttaagcaagcgacccccctgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttatagagaaaaaaaaaat

SEQ ID NO: 13317 - DNA, 380 bp, Homo sapiens
ttattttccttctcccttacaaattatccaactgcactgggagagcaacatggtagaaacatgaaccctatcttcaaagaaagatatatgcacaactccagactacaaaatgtgatgaagaatgataaatgcagttaaaaatgcccacagctgcagatctcacacaaagctggcagaactttctagggggcaaaaccaataatgcccagtttatgggataggatttgtgtactagcagcaggagctttcttggccttcctagggtataaagaagaaagcgggggtgctgggcacggtgactcacgcctgtaatcccagcactttgggaggctgaggcgtgcggatcacctgaggtcaggagctcaaaaccctgtctctac

SEQ ID NO: 13318 - DNA, 355 bp, Homo sapiens
tttttttttggagacagggtctcactctgtcacccaggctggagtgcagtggtgccatcatggctcactgcacactcaacctcccaggctcatgggttgctcccacctcagcctcctaagcagctggaactacaggcgcacaccaccacacccagctaatttttaaattttcttggaagagacggggtcttgctatgttgcctaggctaaagacctttttaaaaattataattgattcctttgctcaactctgtgcaaataatttcaaaacatggataaaggagataattttctagaaattattgtatgtcaacctacttccagaagagagagaaatattacactaattatcaca

SEQ ID NO: 13319 - DNA, 448 bp, Homo sapiens
cccccacacacacacacactcacacacacacacaccccaatcactcagctgtcccatcccacctgccccaccacaggcatcttcagtggtgaagtgggggtgcccatccttgtaggcgattctttccccctatgcagagccctctcctctttccaccgatctggcctgaggcctgtgggtcagtgagtctggatatggagctggttctggggcaagaacagacttgaaggaagcctgcaaaattgaggagaatcccagggctttgagtaacagaggtcagccccccaacttgtcggaaaggaggatgagccagaggcctggctcaagggacagggagagcccaagacagcagctgccagaggcctagggcatgcgcctcaggaccttacctggagcaggccccttaggactccatggggtctgtgcagggagcctgggaggctgtcac

SEQ ID NO: 13320 - DNA, 403 bp, Homo sapiens
cgacttgtttacaacaacctgtaaaacctttaaatactaaaatttaaataaaaactttacctcactagattatttcctcgacaatttatactaagaaataaaaggaatattagtggttgaggtgagagatcaggtctgaagcaaaggaggctgactctgataaaaccaagggcctctaaaagctacctctgtggccagaggacttaggagagatgttgctttgttaaagcgtaatgctaagaaaacaagtaagattaaattgggtaaaaattactttattagttttttgatgaaacagttgtaatcatatcattagttttgatctctgggtatattaataactaaacagcatagtaattgtattccagactacaatttaaaaattaaatgtttcaatgtgtag

SEQ ID NO: 13321 - DNA, 793 bp, Homo sapiens
tctaaatctgaactggacaaatgttcaacttttgaacataacttctagatgctgagcagcacacaccttgctgaataacagatgactcatgctcacaatacagtcttctctccttgctaatatgtttataatttcacaaatattcttatatttctatcatataccaattaagtaattttcaaagtatggttcgtggattctttcaggggtgcaaaatagcacacagttttcaaacaaggtgtgatttgccttttcacaaaggttgctatttgccctgaaggtataaaagcaatgctgactaaaactgccggtgccttggcacaattcaggaaccaaactaagaatacaatggtattcttcactgtcatacacctgaactaaaggaaaaaaacagagacagttccacttacaaatgttcttgatgaagcaataaaaatgactgatttcattaaatcttgaccctgagtaacacatctttttattattctgcatgactaattaggaagtatgtaacaagcctttctccacatgctaaagcatgtcttgaggaaaagcacttctagaactgagttgtgagctgaactagcagctttgttcattgagctccaattttactcaaaagtcaactgggtatttggtagacattttctaaaaaatgaacaaagtgaactttttacttcaaagaacacatctgacggtatttgtgataaaatttatgtttttaagtgaattctagaatactggaaaacttgggccaggcatggtggctcatgcctgtaattccagcactttg

SEQ ID NO: 13322 - DNA, 497 bp, Homo sapiens
gttaaaattgttagcctttagttatcaaagcatatgtcacgaattcagttcatggggatccttgcccacttatggataagagggtaatagttggtatttaaagaaaacattaactgcagagatatgatacagatatgtagctatagatatatctcactgaaatttatatgagtcagaggtggagaatatccaagccatgttaccatcttccagtatccacttcttatgggctctcaaatatcggacctttgcccattgcctaaactgcagttcatcttgccaactggttttgttttgattcctatttattatgtcttaggctgtaatctcatccagacctgattctgagaccaagctctgtgtcttcttgccttacttgctgcttttgacctcttaaactagagcttatcattttaaatggcccaacttgattacactgtagataagactaaatactgtgactctgagaaaaaataaactttatttgtgcgacaaat

SEQ ID NO: 13323 - DNA, 669 bp, Homo sapiens
attgttttctatttcacctgagaaatcttttttagttaagtagaaaattacaatcgtctacatctttcttgctcagtatttttcaagttatagttgccagttgagagaaacgacatctcattttcaggcttaacaggtttccgcaggtccatctgagccatggggcttaaaggcgagcatgcagcagagtcactgggaaggcttattaaaacacaggtcactgggcctatccccaggttctgattcagcagggctcggatgggggattaagaattcacatttctaacaggctcccagttgacacaccagtgatgtcagtccacttttaggtccactggatcatagttttcagaagaaagtctcagccagtcacagaggcgcacgcctgtaatcccatggggcactttcagaggctgaggtagctgggtcacttgagctcaggagttcgagaccagcctgagcaacatggcgaaaccccattcctacaaaaaaaaaaaaaactagctgggcgtggtggtgcattcctatagtcccagctgaggaaggcggaggtggaaggatcacttgagcccagaaattcaagacttcagtgagccgagattgcaccactgcactccagcctgagtgacagagtgacaccctgtctcaagaaaaaaaaaaaaaaaactc

SEQ ID NO: 13324 - DNA, 3082 bp, Homo sapiens
gtacgtgtgtgtgtgtgtgtgtgtgtgtgtgtgtgtgtatgcgtgcctatgcaattttgtcatgtttagctttgtataaccaccactggaactgtttcactaccacatggctcccttgtgctacctctttatagctgcagcttctaatctgttctctgtctataattttataattcaaaaatgctatgtacatgaatctgtaaccatttggcttggctttctccattcagcatgattcccatgagatccatccaagttgttgagattatcgatagttcattccttgttattgctgcattgtgtcccatggtacaggtgtaccatagtttgtttagcagttcacccactgaagggcatttgagttgtttccagtttttggctattacaaataaagctgttatgaatatttgtgcacacagacatacattgtgtgagcataggttttcatttctctgggataaatgcccaagagtggaattgttgggtcataagttaaatgcatgtttagctttttaagaaactgccaaactattttccagtgtggctgtaccattttatattccgaccagcagtatatgagtaatatcacttctccacagccttgccagcatttgatgttgtttttacgtttcactttagtcatgctgatgggtgtgtagtgatacctcattgtggttttagttgacatttctctaccggctaatgatgtgaaaacatcttttcgtgtacttatttgctatgtgtgttatcttctttggtgaaatgtctgtcttttgccttctcatatagtttggatatttgtcgcctccaaatttcatgttgaaattgaatccctggtattagtagcagggcctggtgggaagtttggatcatggggaggatacctcataaatcatttttatagtggcaagttctcactatattattatcatgagaatataccatcccctcctttctttcttcttctcttaccatgtgatgcctgctcccattgccttctgccatgagtggaagcttcctgaggccctcactggaagcagatgctgataccatacttcttgtacagtctggagaactgtgagccaaatcaacttcttctctttataaactacccagcctcaggccaaagaagccctcgaaaatactgaagttcctgttggctgtcttatggtctacaacaatgaagttgtagggaaggggagaaatgaagttaaccaaaccaaaaatgctactcgacatgcagaaatggtggccatcgatcaggtcctcgattggtgtcgtcaaagtggcaagagtccctctgaagtatttgaacacactgtgttgtatgtcactgtggagccgtgcattatgtgtgcagctgctctccgcctgatgaaaatcccgctggttgtatatggctgtcagaatgaacgatttggtggttgtggctctgttctaaatattgcctctgctgacctaccaaacactgggagaccatttcagtgtatccctggatatcgggctgaggaagcagtggaaatgttaaagaccttctacaaacaagaaaatccaaatgcaccaaaatcgaaagttcggaaaaaggaatgtcagaaatcttgaacatgttctgatgaaagaaccaagtgacccaaagtgacctggacaagattcatagactgaaagctgttgacatcgttgaatcatatgtttatatattgtttttaatctgcaggaaaatggtgtctctcatcatttgctctgttaagggaacaaattagcactttttagaagtctgacaattgtaaacagttattagcttttccagaagctgattcccattttaagatgggggaaaattaaggtttgaggttttagaaattagcaagtagtgcatacccttctagccacaagtgcccagtccaggcaagtgctgacttcttagagaatgtgtggccagacccagggacctggagtgtgtttggactgcagtttgccaccctgagaacaccttctccaggactggcatttcagaatcagattcttcattttttgcagctacgatgttcttccagggcactgggggctgtgacttctctctaaattgtatataagttgtgtatatagagaccataattatatggtccttagaaaagactttgcttttataaagcatttagaaaaaatgcatacttttaaaacaagtgcttgagttgtcacttaaaaattatagcatattgctataataaaaccttatttatgtcttatttgaagatgaatagtcttaaaagataaagacataaatgggacaattgttattgagcaaaaaaccaaattatcccaccctcatggagcttatattctagcaaggggagatggatatgatagattacacagtttattggaggacaataagagttatggcaaaaagcaaaaggaacacagggtaaaggggataggtgccatttggtggtgagaatgctgactgaaaaatagaatgatcaatttaatctgaaacaaatggttatttcttttataatccatataataaatttaaaatctaaaatgtaaaattttgaacacaacactggaaagggtatccacagcaggaagtccccagttcacctccatgactacagggcagctttgcacagccctctgggcgcactgtgtgcctctgcccagaagggggcctcgccgttccaccagaagctcagctccaggccctggaggggctgctgctcctcagttgcatttcttcagtagattcatttccttgatgcaaagcatctgtatttgttggttctgtcatttgagcgatgtctctgacttgtttgttttgaattacattacaggctggaatgtaattgtggtgaaagtatttttatattgctgagagtagcagctaatcacagttacatgcttcagaggacttataattgcttggttgtgtgtgtgtgtgtgtgtgtgtgtgtgtgtgtgtgtgtttaactgcatttgaaaagttttatggagaatatgcatgattttaaatctgtgataatgttacatgcaccttcaatttcatccactttaaaaattatcttctcattgaaaaaaaaag

SEQ ID NO: 13325 - DNA, 1162 bp, Homo sapiens
gtacgtgtgtgtgtgtgtgtgtgtgtgtgtgtgtgtgtatgcgtgcctatgcaattttgtcatgtttagctttgtataaccaccactggaactgtttcactaccacatggctcccttgtgctacctctttatagctgcagcttctaatctgttctctgtctataattttataattcaaaaatgctatgtacatgaatctgtaaccatttggcttggctttctccattcagcatgattcccatgagatccatccaagttgttgagattatcgatagttcattccttgttattgctgcattgtgtcccatggtacaggtgtaccatagtttgtttagcagttcacccactgaagggcatttgagttgtttccagtttttggctattacaaataaagctgttatgaatatttgtgcacacagacatacattgtgtgagcataggttttcatttctctgggataaatgcccaagagtggaattgttgggtcataagttaaatgcatgtttagctttttaagaaactgccaaactattttccagtgtggctgtaccattttatattccgaccagcagtatatgagtaatatcacttctccacagccttgccagcatttgatgttgtttttacgtttcactttagtcatgctgatgggtgtgtagtgatacctcattgtggttttagttgacatttctctaccggctaatgatgtgaaaacatcttttcgtgtacttatttgctatgtgtgttatcttctttggtgaaatgtctgtcttttgccttctcatatagtttggatatttgtcgcctccaaatttcatgttgaaattgaatccctggtattagtagcagggcctggtgggaagtttggatcatggggaggatacctcataaatcatttttatagtggcaagttctcactatattattatcatgagaatataccatcccctcctttctttcttcttctcttaccatgtgatgcctgctcccattgccttctgccatgagtggaagcttcctcttctttctctctcttttcctctctttctctcctctgtctcttcttcctctcctttcttcctctcttctctcttcctctcctctctttcttctcttatctctcttcccctcctttctctcccccctcccaatccccgggttt

SEQ ID NO: 13326 - DNA, 168 bp, Homo sapiens
gctgagtggtggctgggtatggaggcgaaggcggcacccaagccagctgcaagcggcgcgtgctcggtgtcggcagaggagaccgaaaagtggatggaggaggcgatgcacatgatactatgctatgcacagtgttttcatgtgggccatgttataagccccacagaa

SEQ ID NO: 13327 - DNA, 2074 bp, Homo sapiens
gctgagtggtggctgggtatggaggcgaaggcggcacccaagccagctgcaagcggcgcgtgctcggtgtcggcagaggagaccgaaaagtggatggaggaggcgatgcacatggccaaagaagccctcgaaaatactgaagttcctgttggctgtcttatggtctacaacaatgaagttgtagggaaggggagaaatgaagttaaccaaaccaaaaatgctactcgacatgcagaaatggtggccatcgatcaggtcctcgattggtgtcgtcaaagtggcaagagtccctctgaagtatttgaacacactgtgttgtatgtcactgtggagccgtgcattatgtgtgcagctgctctccgcctgatgaaaatcccgctggttgtatatggctgtcagaatgaacgatttggtggttgtggctctgttctaaatattgcctctgctgacctaccaaacactgggagaccatttcagtgtatccctggatatcgggctgaggaagcagtggaaatgttaaagaccttctacaaacaagaaaatccaaatgcaccaaaatcgaaagttcggaaaaaggaatgtcagaaatcttgaacatgttctgatgaaagaaccaagtgacccaaagtgacctggacaagattcatagactgaaagctgttgacatcgttgaatcatatgtttatatattgtttttaatctgcaggaaaatggtgtctctcatcatttgctctgttaagggaacaaattagcactttttagaagtctgacaattgtaaacagttattagcttttccagaagctgattcccattttaagatgggggaaaattaaggtttgaggttttagaaattagcaagtagtgcatacccttctagccacaagtgcccagtccaggcaagtgctgacttcttagagaatgtgtggccagacccagggacctggagtgtgtttggactgcagtttgccaccctgagaacaccttctccaggactggcatttcagaatcagattcttcattttttgcagctacgatgttcttccagggcactgggggctgtgacttctctctaaattgtatataagttgtgtatatagagaccataattatatggtccttagaaaagactttgcttttataaagcatttagaaaaaatgcatacttttaaaacaagtgcttgagttgtcacttaaaaattatagcatattgctataataaaaccttatttatgtcttatttgaagatgaatagtcttaaaagataaagacataaatgggacaattgttattgagcaaaaaaccaaattatcccaccctcatggagcttatattctagcaaggggagatggatatgatagattacacagtttattggaggacaataagagttatggcaaaaagcaaaaggaacacagggtaaaggggataggtgccatttggtggtgagaatgctgactgaaaaatagaatgatcaatttaatctgaaacaaatggttatttcttttataatccatataataaatttaaaatctaaaatgtaaaattttgaacacaacactggaaagggtatccacagcaggaagtccccagttcacctccatgactacagggcagctttgcacagccctctgggcgcactgtgtgcctctgcccagaagggggcctcgccgttccaccagaagctcagctccaggccctggaggggctgctgctcctcagttgcatttcttcagtagattcatttccttgatgcaaagcatctgtatttgttggttctgtcatttgagcgatgtctctgacttgtttgttttgaattacattacaggctggaatgtaattgtggtgaaagtatttttatattgctgagagtagcagctaatcacagttacatgcttcagaggacttataattgcttggttgtgtgtgtgtgtgtgtgtgtgtgtgtgtgtgtgtgtgtttaactgcatttgaaaagttttatggagaatatgcatgattttaaatctgtgataatgttacatgcaccttcaatttcatccactttaaaaattatcttctcattgaaaaaaaaag

SEQ ID NO: 13328 - DNA, 472 bp, Homo sapiens
gatttttgtatttttagtagagacagggtttcaccatgttggccaggctggtctcgaactcctgacctcaagcgatctgcccgccttggcctcccaaaatgctggattacagggccctgccactgcacctggctaatttttttgcagtttttagtagagacgaggtttcaccatcttggccaggctggtcttgaactcctgacctcatgatccaccccactcggcctcccaaagtgctgggattataggccagaccctgcctggctgaaacttaattcttaaatgtttcttttgcttttcatcttgtgatgtataatgtacaaggctaaggctgtttctccaacttatttttaagttttttattaatgagtaccacaaaaatttcagatcccaaattgggttcttgggaactgtgaattcaaaatgagtttctggcggaatactgtatatgcctcttgtttcttcctgaatt

SEQ ID NO: 13329 - DNA, 310 bp, Homo sapiens
acacttaataaaataaaataaaataaaataaaataaaaatggatggtgtcccataaaaagcactagacatttccatctccatctttgaactatgctataccttccagaagggatgccaactagtacatgaaaactatctagaaacacagataggaccaagcttcccttctctgaattcttacagcatatgtttgaagactgctgtgtttgtaatctctctctgcaactcaaatgttttgaacacttgtgatgcaccacagattcttacagggggataaacatgaatgagatatagattacccttttgggg

SEQ ID NO: 13330 - DNA, 165 bp, Homo sapiens
ctgtggggtgccagtgctcccagcagcgcgttcaccagcactggcaggtttggagagctgtatctgattgggccttgggaactgaggtaggctgcattgaagagatttgaccatttttaactaagttatatgagtttttttgaataggtgatacatttaaaaagt

SEQ ID NO: 13331 - DNA, 717 bp, Homo sapiens
gaccttcagctcacggctccaggcctgggccagttcttgctgctcctgccgtctcccccgactggctgtgtcctgagtaactggaacatgagactgtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggag

SEQ ID NO: 13332 - DNA, 405 bp, Homo sapiens
ggtcgacggacacacaaaatgccgagtgtggaagggaaagaaggctggcgattgctttttaaggtagcaagttggaaggggggcatgcggggactatgggtgggtggggaattctctaaagaatacaagtcccaaaggctgaagtcacctgtgaccacagggcctcagtggctggctccagtctctacacagcagccacagagatatctccaaaatgcaaatcccattgtccactggtgaacgtcaaactcttccgcatgcttacaaaccctcccatgttctcgcacctgcttacaccacctaactctgctcccacctgtattccaccctcgggctatatctgtaggcctttgcacatgccatcctctttgcacatgtcatcctttgtgtctcagctgagatcgg

SEQ ID NO: 13333 - DNA, 499 bp, Homo sapiens
cctgccctttgagcaggaggagcgtgacctcctgccacagctacagccacaattattgaaattgtggtcaacattccatttaaagcattaaagtctgttgttttagtcctgactaagcagtaggcttctatggattgggtattttttttttttacccacccaaatgtgttttatgttgagatgtttcgagtttttttggggggttgagggtggtgcaggtcgtgaggggcaagagctgctgcataggagataattctctttaactgattaatgtttttgctttattcaacagctattgaattaggcagtctgtacctttagtgttttccagaacaaatgtgttgaagtggcagaagggtggaagaattgaaaattattcttgcacagttgcacctgagttgtattattgctccatgtctccttatgtgcacaagttttacacagttatcttgtcttcctatctcaattgtgaataaatcagaagttccctgttaatgtt

SEQ ID NO: 13334 - DNA, 418 bp, Homo sapiens
tgttgctccatggggcaaaccaaactggatgtaactcaaacaaaattagacactgcatactctactggggggtgtgcccagcatttgggaaaactctgtgtgacttacaagtgccccaaatttggaaagggttcctggcaaagaaatgatttttttttttaatttctacaactacacaagcagatagtgaattaaagccttaaatggcacttaataaagaggtcactggggcaagatgaccctgaaagctacaatggtctccagtacccaagctgttatcatcttcgtagcttcagaaaccctccaaggaaactctcttgatgtggctacttaatagtataacagaaaggtgtaagatcaagtttttcccccatactgattagctgaagactaaacatggtgaagtctttttcttttt

SEQ ID NO: 13335 - DNA, 380 bp, Homo sapiens
acacacccaacacaacaaatgaaatgaaaataagacaaaatatcaagtgttaggaaggaaatagaacatcttgactcatatgctgttgagtaaaaaaacactaggcacttatgcatgccatatgatccagcaattccacctctaggtatttgttcaacataaacgcatacatatgttaaccaaaagacaggtactagaattagaatattcacagtaacactacttgtaatatcccttaactagaatgcccactagcagtataatagatgagtaaattgggatatagtaacaccactgaaatctacacctcaatgaagatgaataaattattgctacatgcaatcgcatggttgaagatcacaaatgtaattctgagtgat

SEQ ID NO: 13336 - DNA, 775 bp, Homo sapiens
tatcattcatggctttgacgagtaactgtgatggagtagtaggggataaagcctcacttgagtgggttcaagagagatgagaggaaaggagaaacagtgagtatagattactgtctcaggaatttatcttataaggggagcagaaaaacgtagctgtcaggaaaactggggtcaagagaattaaaaaaagatagaatagaatagacaacccagtaagtgttttattgactctacgaatgtgacaccttgcaggcagataaaaatgtgattcaggaatttagaaatcaatccaagacaatgaataaaaataagaagctatgcatgaagataatgataaatgtagaaataaatagggttctcatgtgtaaattgtagagagatgaaggaaattttgcatggccagaaccttgggaaacattcttttagaaagcaaaaaaaaaaaaaaaaaactcgctcgtgccgaattcggcacgagccaaatatgagatgcgttgttacaggaagtcccttgccatcctaaaagccaccccacttctctctaaggagaatggcccagtcctctcccaagtccacacaggggaggtgatagcattgctttcgtgtaaattatgcaatgcaaaatttttttaatcttcgccttaatacttttttattttgttctattttgaatgatgagccttcgtgcccccccttcccccttttttgccccccaacttgagatgtatgaaggctttcggtctccctgggagtgggtggaggcagccagggcttacct

SEQ ID NO: 13337 - DNA, 355 bp, Homo sapiens
ccatggctattatactgcaaaaaccaaaatcaaagccaaaaaaccaacatgcctaattccttgagtccactagatgtttgcatgcctcttataattcttttagtaaatgccttatgtcatttttatattttaactattgtctcaaaatgaccacagtacgtttatttggaatttcaagtaggcagaaagtatgccaagaacagttgttccagaagactcttgaggtgtatgtttgtttaattagaggcaggattcggtgggcaaacaagacagagaaatgttgatggggaaaatattggctctgtaagtgtgcttttggtaaatggtagtatctgtagtgaccatattcaaagaa

SEQ ID NO: 13338 - DNA, 377 bp, Homo sapiens
tgtggtttctctaccattcctcctggattgtgtccaccttaaccagtgcagtgttatcctggaacagaggaaaccacagacctccagggcacacattagagaatactatttgcaggtttaaaaagataactgaatgacaaaattaaaaccagtttggttgaatgtttctcatcctgttttaaccacaaggagcagaaagatctgaaattctacagagattagaattttatcagaagaacttcaacatgataataaaattcaccataaacttaactgaataagagcaataataatttttaaaaagcttaaaaatgtagttgaattacctgttcaatattgtatgaaatgtgttcacagtaaaccttttgcaaatgtca

SEQ ID NO: 13339 - DNA, 307 bp, Homo sapiens
gattgctggtcacaggccacagtgatcttttgtggctttcatgtatatttcatcatgtttagtgcaatcccataaaccttgaataacacgatgggacccatatggagtgccactactgatgctggaaatgctcccaagaagcagaaaaaagtcatgacattacaagaaaaagttgcattgcttgatatgcactgtagattgaggtctgaggtctgcagctgtggttgccccgacttcagacagatgatttgtcgtgtaaacagaccatgtaaacttacagcgtcaataaatacatttcagtactgta

SEQ ID NO: 13340 - DNA, 507 bp, Homo sapiens
agcagattactccacacgtttttacacactgaactctccagtccttccacttccttaattctgcaaatggagggggtggggactcttgggaaactactcctgtaaaattgaagttggaggtaggcgtgggctgaggaaagaggaatcagattaattctctgggttgcaaagaggctattctgcaagccccttacagtggccctgaaagctcaataagtgttttgtacctcttgtaaatgtgccattgtgtgaagcattaaacccaacatctagaattcaggattcatccagaataaaaggatgtaaaatctttcccaacagaagagtgttacttttggtcagacaacttcatgggttcttactgcacattaaattatgacttatggaacattgcaatatattctcggtccttaagttatgacttatggaacattacaatatattctcggtccaagtgagtaagttctttgctttatgtgaatccaataaaaaatccaaagaatttta

SEQ ID NO: 13341 - DNA, 436 bp, Homo sapiens
ttctctgtgtttgaagaacaaggaaaagactgggggttttattagaaaaaaatgtgtattgttttgaaagaaaactaattggcactagagaaggttttgggagctggcaaactggtgagtgagagtgtaaatggtgactggctaaaacgagtcttaaatcttattcattcttcctaacacaatagggtaactacagttagtcataattgtacacttaaaaattactaaaagagtatatataattggctgatttgtaacacaaaggataaatgtttgaggggatggatgcctcattctccatgatgtgactcttatgcattgcatgcttttatcagagcatctcatgtaccccataaacatatatgctactatatgtacccacaaaaattcagtattaaaaagtaaaaattaaaaacaaaatgaaataacaaaaaaa

SEQ ID NO: 13342 - DNA, 462 bp, Homo sapiens
aaatttaaacatttcatccagaaaagatatggagatggatcatccagaaaagatatgagcatataaaaagatgctcagcataatctgtcattagggaaataaaaataaaatcacagtgagacactactacacacctattagaaggtcaactttggcacattgctgatggggtgcaaaaatggtgcagacacttcaaaacagtttgacagtttcttataatgttaaaacagacttaccacacagcaatgccacaccagagaaatgaaaacttacgttcacacaaaagtttatacgtgattatttatagaggttttattcacaattgccaaaactggaaaataattcaaatgtccttcgactaattaaacaagctgggatatatccatactgctgaatgctgtaattcagtggcaatgagatacacaagtactataatatgaatctcaaatgcagtatgccaag

SEQ ID NO: 13343 - DNA, 433 bp, Homo sapiens
tatgtgaaaaatactctatatcactaatcatcagagaaaaaaaaatcaaaaccacactatcaccttaccctattcagaatggctatgattaaaacaaacaaacaaacaaaacagatgttgggatggatgtggagaaaggagagctcttatacaccctgattggaaagtaaatagtataaactctatggaaaacagtatgatttctcaaagaactaaaactcgattactattcaatctagcaatcttactactgtatctatgcagaggaaatgaaatcagtatatgaaaaataaatctgcacttctatgtttattgaaacaccatacacaacagcaaagatatggcatcaacctaagtaaccatcaatggatactaatgggtttgtaggtaaagaaatcgtgatatttacacaatgcaatactactctgcaaaa

SEQ ID NO: 13344 - DNA, 301 bp, Homo sapiens
tgcctgtataggttgcttaccataaataaagcttgcaggttggaagttactctgggtgagtcagtgagtaaatgatgagtgaatgtgaggcccttggacatcactgtaccctactgtagactttataaacactgtacacttaggttaccctaaatctattttaaaattgttttctttcttcaataataaattacccttagcttactgtaacatttttacttgacaaaccttttaatttttaaaattttctgactgttataataatacttagcctgaaatacaaatgaattgtctaagtgta

SEQ ID NO: 13345 - DNA, 4256 bp, Homo sapiens
agcagacattttcaaaggcttctctccccttcttctcctctctctgtcccccatgcggaaaggggaaaatagaagtagaatccagattggggcgcgtggctgatttggtcctcctcccgcaccatcctcccccagacagcagagaaactttgatgtctgggtgcatggcattcagggacagaggagcctgggcatcccagcaaatgcagccgcatgttccgcctctggacggcctctctgaactcctttgtgaggggagatgaagcccacagagctggaaagagcagcgttttgaaatgaggaagtgtggatcggcattccttgagctcagtgctagccaccttggcgatggggtgagccaaccaggagctcagatttataaaacttttgagctttgtgggccctagggggccactgtggcctacctgctgattttcagatggggaaatgggggctcagagaggggacaagatttgcttaatggcacctagcaaattggtaacaggtccaggagtagattccatgccttcagcctctggtgagacgtctttcctctgcaccaggaagtggaacttcaaacagcaccaggggttggaacttttgtttcaaatcctctctgcctcatccccacccactgcccagcaactcaaggctgggtctttcgccccctcaggctcagaagggctgtggcccagccacagagccagggggcctcctcagtagtattggccttcacactcttggtgctaaagttctccagttacttttttattaaaccaacatgtacagaaaaactcagttttcggctgggcacagtggctcacacctgtaatcccagcactttgggaggccgaggcaggcagatcacttgaggtcaggagttcgagaccagcctggccaacatggtgaaaccctgtctctacaaaaatacaaaaattagctgggcgtggaggcgcgtgcctgtagtccctgctagtcaagagggtgaggcaggagaatcgcttgaacctgggaagccgaagtagcagtgagccgagatcgcgccactgcactccagcctgggtgatagagctggagggaaaccctgataccacttctgggtccagatggctgtggctggaatgcggccacagccaggaacagcgtggtacggataccagtggggctctggtcttttcccagaggctggcacctttcatgccgagttgggcctcgggtctcggggctctaggccctgctgtgccagtggcctgatgtgtggccttatatgccagtcacaccctgctccagacctcggtttcctcatccacaaaatgggaaagctgggctagaaaatctctcaggaaggtaggtctctgctagctcccagccttccatggcagtgcaaagggaaccttcccaacaaagtaagagccaaaggctaagatggcagtctgtggtttgtagaaccttctagaagaccacgagacttggtaagctgagcttctaagtggtccaggatgcagggctggtgtcacaggtgtgtgaccagtagagctacacagggctttgtgcccagaagggccccacgcttgggaaataaggctctgcagtcactgtcttcaaattcttaataattttatctttgtcactgtgttttgtaagtgaagtccaatgggacagtggaatgtgaactgggagcatggagcctcccatctccctgcgtccaggatctgcttctcagctgcttgctcctctgcccccacagctccagctccagctccactcaccttctacctccctgcctcccacccagcaaccactgccaacctgcccccaacctgggcacaggcacaccctgtgggggagggggacaagcacaccccacagcatctcagagtggggcatggtggcagcagtccccatcctgcgctggcagcccagggcacatttcgtgtgggactctgcgggggtgagcctctagccccccccagatccagtacctcgtgtgtcctggtacaaaatttgtagtgccccgggggctgcccatctgctatgggttggggcaggggcctgtgggaggatgcctggctcaacctcctgccctaggcctggagcacaacatgtgggcccagcagctcacaggaaagggagccagaagatgggttcaagtgtttgtgtgttccccaagtcaccagggtgcctgtgggggtctgcactcccccaggagaaccctcatgtctagggagcaccccatggggtcatctccatgcctgagaggaccctctcttccttctttcaaccttccggagcccagcttgtctcttccggccaggtcaaggtatcctcctgagagaaccgtgaaatacagtgtgccgctttgataattccacatgcatgttcaatattcggatatttccagttaaaactggcattgcacaatataaaaaggaatggtaaaagtcatgctaataatttaaaattttgactttacttagaatggtattaactagcaaatttaaaacaccatgacaaattgaaagtgagactggggaagaaagcaaaaagcatgttttctgactgtttgaacaaggggccccacattttcattttgtagtgggtcctgaaaattatgtagccagtcctgcctggtgagccacctaccctcttgggcatttagttgtctatcagtaaactagatcattaacactgcgcctgcccctcctgctcacgggcacgttaggaacatgcgcttggataaaatccaagccagagatttagaaaccagtgtgtggtgccagctctcagccttggaaccacaagcccatttttcttaaaaagggatctggactggcatccaaagagatttcagtcccctcatgtaggtttaaccaccatgggcaaggcagtctctctcccaggtattcctctcactaggtgctctgctctagaaatgaagtctaaaagcagccccatcaatacagaacagagttagaaccacccggagagatttaatctggaatcccagcaagttgtgaaatggaaagactagtcggccagagagctgaggtctcacagtgtgcaaagaccagtcctcagtatctgcacccatccatttgagtttcaggtgaagcctaggatttgggagctcaatacaaagatgccagcatgaaggagggtgggtgccaactaggtttggatttagagacatcctccttttgggaaaggaaaaaatcctgattccacttaggtttccaggaagaaggcatccccatttcagaacagttttctaagccaccctcatggaggtttcacctgcagctttcagtctgctttgtctgatgtttgaggatgcaactgcccaaaaatgggtctaaagtagcatcccgtcacgttctgtaaaaagtaatactgctttaaggtaacacttatgggaatgaatggaatgcatgaatgaatgagtcagtttggatgaagttgcctcaaatagagtctaaatataagatttcatactcgatagtgtcatttcaggatcaggaaaaattaggtgactcccatttggtttctacagcttttccccaatatcatgttaaagttttggcttttatcttatttcacttatttcattttgagtcatgtcttctggctccagctcagcttcctagagataattcattaggcccgagagctgctccagagtgggattagaacccgtgtagtacatagtcacattaaactgagatcggctaattaatcgctcttctccgtgtaactgagcgatcgcgctccttccccgaggaattgcaatttcatggttcctaatgatggtgcgattacattatgtggatcacttaggctgtgggtgtcaggagcggtacttggagcctctctcggtggggatgggagaagtcacttctaaaaccggggagatggaggaaagcagttagaatgtctgttactaatttttgttaacgtgctgctgtttcctacatctcattcaggcattagtttcaagttccattttcccccagcaccgtgtggcaccttccccagaaccctcacattttttttctaatattcacagggttattgtttgtaaaaaatctatttatttgctttattccatcaagtaatttattttcatgagatttcttggaaatgtggctctacatatcgttagtacaagtaatacattttgattgttgtttcctggaataacttgtattatttgatgagttaaataaaatgcctaattctaaagtcggcaaaaaaaaaaa

SEQ ID NO: 13346 - DNA, 873 bp, Homo sapiens
cccatggaggatgatgaggacagagatgaggatgaggaggatgaggaggacaaggaggaagatttggatgaagttgcctcaaatagagtctaaatataagatttcatactcgatagtgtcatttcaggatcaggaaaaattaggtgactcccatttggtttctacagcttttccccaatatcatgttaaagttttggcttttatcttatttcacttatttcattttgagtcatgtcttctggctccagctcagcttcctagagataattcattaggcccgagagctgctccagagtgggattagaacccgtgtagtacatagtcacattaaactgagatcggctaattaatcgctcttctccgtgtaactgagcgatcgcgctccttccccgaggaattgcaatttcatggttcctaatgatggtgcgattacattatgtggatcacttaggctgtgggtgtcaggagcggtacttggagcctctctcggtggggatgggagaagtcacttctaaaaccggggagatggaggaaagcagttagaatgtctgttactaatttttgttaacgtgctgctgtttcctacatctcattcaggcattagtttcaagttccattttcccccagcaccgtgtggcaccttccccagaaccctcacattttttttctaatattcacagggttattgtttgtaaaaaatctatttatttgctttattccatcaagtaatttattttcatgagatttcttggaaatgtggctctacatatcgttagtacaagtaatacattttgattgttgtttcctggaataacttgtattatttgatgagttaaataaaatgcctaattctaaagtcggcaaaaaaaaaaa

SEQ ID NO: 13347 - DNA, 351 bp, Homo sapiens
aatgggccaatcatactcccaactagggataatgtgcatcatacatacttggaatacagtgtggtatcattattccattttacagatgaagaaaatgaggctccccaaagttatgagtttcaggggcagagtttctcctcacctcactctaggccagagtgatctccttacagaatctgtgattttcaggctggatcacagaactgttgggttctgtgggccagtgagagaaactgggggatatcaagcaggcaggcagggtctccagcctgaccagccaggtgcctgctacaaagcaacacttgatgaatagctgttgaatggatgtatgaatgaataaatgtgtcaata

SEQ ID NO: 13348 - DNA, 473 bp, Homo sapiens
aaaaatggctccaattctactgtcttattcaagcaaggtatttacttcttatttcttttctatccatttcatgaccttgttttatttcaagcactatcacagagtcagatggaccttaactcacctgagcaaaggcaacctagagccacacagctgagctgccctctttgtggcatcacgttgtccctctgccccacagagtcacctccccacttcccttttccagccctactgcccttttgtaagtgtaagacatcatttcctctcaactgcataacagaaatagcctctgaaagggcctttttacagctgatttcttctgtctccaattcatcgtccatactgcatccaaagtcttcttgccactgccttcaaaatttaaagctgattcctaaattatgaatctttgtcactgggaaggcaaaggacagttgcatagtctggttgagtgaagttttgcccacacttaactg

SEQ ID NO: 13349 - DNA, 222 bp, Homo sapiens
tttcacaggtttgaataaagggattgtggagagaaagcccagtaaagcagatgagcttgctcaggatcagggccaccactcaggggaataaagctctagggacctcccctttttaggagtgtaggttcccaagatctccctcctaaatgaagtggccgctgctcactccagggaaaacgaatcttgttaccacatccaccacggatggctagaacaggggac

SEQ ID NO: 13350 - DNA, 314 bp, Homo sapiens
tgaatattatacagataccaatccccagagcttattaaggtccctatttaagaataaatatacattgctaacagtgtaaatttggtgaaatatttcaagagccttcaaaatgttcacaccctttctccaaggactaaatagagaaaaaactttatgcacaagatgctcaaacttctcctttagagcctagataataactctcatgtcttcctcaaggtcttctcttcccagtttcatcaacctttactcacctggtttccagactgttctctatcctggttgtttccccctaaatggactatagtttgttagtg

SEQ ID NO: 13351 - DNA, 437 bp, Homo sapiens
gcgtgcacacgcacacacacacacacacacacatgcatcttgttggttctatcttctagctgttcttcaatcagccagcttccttctatcttctctgccaccaccctaggctaagctgcaagcctctggtccccacttctacagcagcctctttactggtttccctgccatatgttttgtcctccctccaaccagttctccatgttgtatgtaaccagagagagcttttaaaattgcaaatctaagcttgtcatttctctttataaaacctttcaggtttccgactgggcgcggtggctcacgcctgtaatcccagcactttgggaggccgaggcgggcgaatcacgaggtcaggagatcaagaccatcctggccaacatggtgaaaccccatctcttctaaaaatacaaaaattagccgggcatggtggtgcgtgc

SEQ ID NO: 13352 - DNA, 1269 bp, Homo sapiens
cagtgaaaacaccagctctggcaactgatcctgcttttcaacattgtctgcaatgttgtgtctcataaatataatatactagcagagatattgacagttgagggtgttaactttcttagcctgtgtgttcattccagacagcaccagagataatcaaactgacttctttggttttcatcacatgaaaccatggctgttttgtttttctgctgaatgcctgctcccagctgtagccctggcccagccgccttcctgggagagggctgggcaggacagagctgagggtgggcaggtgcagctgggacttccctccctctgttctgccctatgcccatccttagtccaagggctgggtattgttctttggtgattttcttatgtttccaggttgccttttaggggaagcttgttcattcccagccctcactggctgacccacctcaaagaccagggctggccagccccttccgcagcctcagagcagctctctagcctccaggggtttgtcctgttgtaggagcaggttgcatcctgtgcctctccctgcagctttcactgctcttgcctaattaaataatctgtagtttccaggacagtggcagaggctgatggaggagggagggtttttgctccttaagaatcatgagatcatggagcagaaagttaccccctcctcttgaatcacttaaagtattgtgccctggggcttagagctagggatcctagctgccagtgcttggagatgagaattgctgaagatttgcccaaggggcatcagtagcttttgtggagtaatgctagccagtgatgcttttgatatttcagcacagtttagtagatgatttatggaaccaagcagtggctccagataacaaggatcctaggcaggtatgggtcagtaagtcggacagggtgttattaggcctccctagtggaagagtctcttggataggaagccttaagcctgggaaggcaattagggtttcagagtttcatttactgtcctcaaatatacattaagccctactttgtcctctgcacaaagatgtatttgatgatccccagtggcacagagctaatcctgcctgggggttaatcctgcagtttaatctcctgttcatttctgtctgacttgagtacccggggtccatcagtcttgtccatcatttccaggtgaggcggagcagaggtttaatggaggtgtgggatgtttgcattacgctaggtcaattccattgtccttaaaaaatgagaacctttctgatttga

SEQ ID NO: 13353 - DNA, 441 bp, Homo sapiens
tgcttcagattcctggagtagctggactgaaggcagagatgaggggcttgttgacctgggagctctttatagctaatgctgcttggcttcagttcctgaggcctgccgccgtagggcctgcctgcaaacgcactgtcaccaccccccgccgctgcagccccccaggagttacgcttttgcagaagacccagctgcctaagtaaaattaaacaccctcaagctgtttgaggctcttaaaaacattttctcagcactgaacttctctgaagatctgagactattagcacaaaaccaagagttctctctaaactgcttttctctttcccctgaatgcaaatgaacttcccctgctggtttccattcatctgacaggtcataattgtgacgttggtaaaatagagaaagttcccttttgaaaattgagctatgagaacttttttt

SEQ ID NO: 13354 - DNA, 109 bp, Homo sapiens
tgtatttatttaagaaatactttgtcaacaactttaaagcccagcaatttttccaaggctgcctggtcattttaaaataaatactctgcttattcaccacgaatagcct

SEQ ID NO: 13355 - DNA, 406 bp, Homo sapiens
catccctaccattcagacacctcccacccagcccacctccactgttggaaatcacattgcaacatgagatgtgggggacaaagatcctgcaaaccatgtcaagcaagattcatgacacctcttcttctaacataaatctaaatttctttttaacagggaaatggtttacctctggaatctttaatttagattcatttatagaaaattacataaaattaatttttaagaaggatacagaggcgccactgtgttgattgagaaaggaatattttggatggatctcagcattataagatgtagtattatattaagtactatattttcttgaatagtaatataaattttgcctggtatccttacagagtgtgctttttaaagtaaataaagcttcactggatcccctgga

SEQ ID NO: 13356 - DNA, 473 bp, Homo sapiens
cgtgagccaacatgcctggcctgtaggacaagttttataaccccagaaatacagagcaaaacccttatttgttagaatatgtcatccctgaaatcaacgttaaagcacaaacttaggaacaaaattacttgcaacatataagaaaggataaaagaaggctcacataaatcactaaggaaaaaacaaaataactttaaaaattggctgggcgcagtggctcacgtctgtaatcccagcactttgggaggccgaggtgggtggatcatttgaggtgaagagtttgagaccagcttggccaacatggtggccgtctctactaaaaatacaaaaattagctgggtgtggtggcgcgcacctgtaatcccagctacttgggaggctgaggcagtagaatcgcttgaacccaggaggcagaggttgcagtgagccaagatcgcccactgcactctagcctgggcgacaaagtgagactc

SEQ ID NO: 13357 - DNA, 6076 bp, Homo sapiens
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13358 - DNA, 6157 bp, Homo sapiens
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagtactgactgctttgaaggttattgctggtttgtttagtctgaaaatggaagcagtttatctttgcaacaggaaagagaaagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13359 - DNA, 6763 bp, Homo sapiens
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaactacttccattttgtctcattacattgtagactttgttttaaccaagtcagaaagctgattttcttcaaattaaatccctccaatgtgatgggatcaatttggttcttacatgtaattgattagtgcctaatatttttacactagccacttactgagcattttatatcccagttataaatatgaaaacactgcatgacaatgtgttaaaacattatgacatcagtgctcattttattgacatcactgtagctttcaggagaaaaatgttattttttcttgaactctaatagaaatacatagaaaaataactttaagatatgttttgtgaaattgcttaggaaagaaaaaaattttatgccatgtgaataaaaatgcctgcttctctttcactttattattgtgtcccttatgagttaccaaaataacccatgacatttgaccatgccccagctggtgcttcatggggtctgctggtgataatcatttaaagtggcgtcatcttatttatgcctttcattatgtggatctgaagcttaactaccaatgttcataggctgaattattccttaattgttgttcattacagccactgatctcattttttatctcctttgagtcctcaaatatttatcatttacgtgttatgaattaaaatctggaatttattaaagtttgatcataattta

SEQ ID NO: 13360 - DNA, 5441 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13361 - DNA, 4880 bp, Homo sapiens
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccatagaaatggccatgatctagcagacatgctctctaaactgagtaactttggtaccgaccggtg

SEQ ID NO: 13362 - DNA, 5477 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaatcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13363 - DNA, 5199 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatccccaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13364 - DNA, 1625 bp, Homo sapiens
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagtactgactgctttgaaggttattgctggtttgtttagtctgaaaatggaagcagtttatctttgcaacaggaaagagaaagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtgagtatatgagcaccttagcatctcttactgcatgatagcactctgatttgttaataaaattgtttgctttcagtatttaa

SEQ ID NO: 13365 - DNA, 833 bp, Homo sapiens
taatgcccatttaactttattttttttcttttcaaagccatatgaaggattaaggcctcaggatcttcgtagactaaaagatatgcttattgtggaaactgcagacatgcttcaggctcctctctttactgctgaagctttacttcgagctcatggtaatgaaagaaatgtcttatgcttctaagaacatgagtaacttttgaaacttctgagtttttaaaagggctatttttgtatttgaatacagaacaaaatggtttgttaaaaaagcctaagttgtgttttgtgcagttgttacttctatactcagttcctcataacatcttgtattttgaagtataaattggcatatatctaagaggagacactggaaaattctttttagaaattgagctactaaagcaaattatagaatgtctaattttagaaatatgtctaatttgagtgagattgagcattgaaatccatagtcctagccctggttttgacattaatttttgctgaagtcattcaagtataaaattatggtagttcaattaaatacctaagaattgtgctattagtattgtcagttgtatttattttatatggtagctatttctccccatgaagtgcacaaagtgaagttaaagggtcaccttggaaatatattgtcccttttaagggtggttttcttgtttctttgttttgttttgttttttagacataactaactttatataagaaaattttcctaagtgctcagtttaagttccctataatccttatgacaggcattctgggagctctcacatgctggattggatcttctcattgcccacatgatatatgac

SEQ ID NO: 13366 - DNA, 5531 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13367 - DNA, 5068 bp, Homo sapiens
cgcagcggccggagagggatggggggcgcccacccagtctgagcctcgccgcgggcgccttcggctcacgcagcgcttcccgcgggccgccagtgcgcaccctcggccacatcagcctccgcctggcgggtgcacccgggccggcgaggaaggggcaaccgtccgggtgggtggggcgggctgggtacctgaggtcaccagctcggctgtagaggcaggggcggcggaggcggaactgcggagttgctgggtccaccgacccttaccctcagcgagagaagtaaccaatgtgaaagatgttgcagaagtgttccagaagtggctgaagatagaaggaaaaaagtgccactgcctatcagaaaaaacaaaacaaaacatgggaaatacaaccaccaaattccgtaaagcactcatcaatggtgatgaaaacctggcctgccaaatatatgaaaacaatcctcagctaaaagaatctcttgatccaaatacatcttatggggagccctaccagcacaatactccattacattatgctgctagacatggaatgaataaaatattagggacttttcttggtagagatggaaatccaaataaacggaatgtgcacaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgtt

SEQ ID NO: 13368 - DNA, 5479 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13369 - DNA, 5513 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaaccttacagggaatttcctttgtacttaattgaatagcttttcccctttttgctgacaaaaagaagagcaagagaaagagaaacaaaaatgaaataaataagttgtattccacactctaagaaaatgcagtcctctatttagcctaggcttgacaatacttaaattgaacatttaaactaaaggcttactccctaatctttgggtggctttcctttaaaaaaaaaaaaaaagttttcttcattctagaaatttattttggataaatccgataacatatatgtcctcaatctctttgtgctcttccataacttacttcctttttgtctgagcaatgtgaattgaagtctctttagtaccacatctaccatagtgtaattagttttaattttcacatgaatcaaaggtttcctttcatgtctatttacagtccaattgtgccaaactcttacttgtgtgctgactaacaaggcatttaggtgtgcagcatcctagagtgctccagggcagtgtcagcgttctcgggagtaaaaggtgccacttggtagcaatgatattccagaattaaatgggtttttgttgccatggagactgcatttatataaatgtagcctgtagcttaagttaactaaacctaatgctgctgttaaaaacagtttattttaatattaaaatacagttgattagcaacagcggtgctgtattttaagagacactttattggaagtgcaatcatagttatttgttttcacaattttacagtgcattctaattactgatgggtgcaattacttttaatcgtgttttataaaatagaaaaaaagtggagttttcatgagttatagtaaatcccacgattattaagaaattcaataaaacatcctgcgcaacatgttaccgtgcctttgcctaacctaaatggatagttgccagttaaataagtgagtaattcaaatttcaatgtctcttctgaagtaactatgctatgaattgcaaagacctccataaaaccacccatggccttgcttttacactaactataacaactaaatgttcaatcagtttgtttgcctaactagcaaatgctgacatgtgtttgttctactgcgcaatactcatttgctgtgtgattactgtttagtgttgaaaaaaatcaacttcctagttatcagtgtcttactgtgaagaaaatactggtcttagttgtaattaggatacaatggtacagtgtgtaattaaaactagagtaaactgttggaatggctgttttacttaaatattatcaaaactagcataacataagcaaaatagataagtacaacactccatttagtgttttgccagattgttaccagaagtctacagataccaaactttcagttctgagtttgtacaggcaagtcctgggctgggtaaaaagttatattaatattgttatccacaagagatgtgattatgggttttgattactttttttttttccaaaccctgcttttgaaatatccttgtacttaaaattcatattgctaagacactgtattagaatatttaatattccccagatcctcttaggataaactgtgggaatcctcctatgccatggatatcaaaggtccacattagtttttatttctccagtgatcagaaacattgatatcaatccctattaaattagtggggggaatattaactttatctacagtgtattactgtatattaaactgaaatagtccattaaaggatttttttataaatttattttggattaaaaatatcaacaccaataagtttttagaccaagttgtaatttttccaatatagagtctttgcatcacactgaggcatcttgcacagctgcagttaaggtgagaaagaatgctctgtgtgaagacagtgtacacaatgggttccggtttccttgcaccttgtgcagtatcctttatttctgtgctgttctctcctgagcatgaaaaatgatcattatccaatttgtatttccttggtacatattttaaaaacaacacagtcattgactttacaattcagtaatgaagtttggcaaagcctattttgtaaacaagttaattttataatgtaaaaaaaaaaagttaatctaaccttgacttgttatttgcactttcatagtctatacttgatacattcccactttatatacagtaggattctacaaacgtgtagatgtttggccaaatgaatgctgttaataatatgtaaaattctttgattaaacatttattacttaa

SEQ ID NO: 13370 - DNA, 3343 bp, Homo sapiens
tcatattcactctggtcaagttttgctcctttccattttaagatcatctgcagacaatctgctctaatgaaacatctatgcatttgttgtgtatgggacctcaaattatgatatctgaaggagcccttcatcctcgcttggcacgccccacagaagatgatttcagaagagcagattgtctgcagatgatcttaaaatggaaaggagcaaaacttgaccagggtgaatatgagagagcagctattgatgctgttgataacaaaaaaaacacacccttgcactatgctgctgcctcagggatgaaagcctgtgtagagcttttagtaaaacatggaggagacttgtttgctgagaatgaaaataaagatactccttgtgattgtgctgaaaagcaacaccacaaagatttggccctcaatctggaatctcaaatggtattctcacgggatcccgaggctgaagaaatagaagctgaatatgctgcattagacaaacgagagccatatgaaggattaaggcctcaggatcttcgtagactaaaagatatgcttattgtggaaactgcagacatgcttcaggctcctctctttactgctgaagctttacttcgagctcatgactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttgtgtgacatttgtatgtgcagtatctctgtatttgaagaccctgtggatatgccctgtggacatgacttttgtagaggatgttgggagtcgtttttgaatctgaaaattcaagaaggtgaagctcacaacattttttgccctgcatatgattgcttccaacttgtacctgtggatatcatagaaagtgtagtttcaaaggagatggacaaacgatacctacagtttgatattaaggcctttgttgaaaataatcctgccattaaatggtgtcctactccaggctgtgacagagcagtaagactaacgaaacaagggtcaaatacatctggatctgatacactcagcttcccattgctgagagctcctgctgttgattgtggaaaaggacacctcttctgctgggagtgccttggtgaagcacatgagccttgtgactgccaaacatggaagaattggctgcaaaaaataaccgaaatgaaaccagaagaacttgtgggagttagtgaagcctacgaggatgccgccaattgtctctggttattaactaactccaagccttgtgccaactgtaagtctccaatacagaagaatgaaggctgcaatcacatgcagtgtgctaagtgcaagtatgacttttgctggatttgccttgaagagtggaaaaaacatagttcgtccactggaggttattacagatgtactcgctatgaagtcattcaacacgtggaggagcaatccaaggaaatgactgtggaggctgagaaaaaacacaaacgatttcaggaacttgacagatttatgcactattatacaagatttaaaaaccatgagcatagttatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaaacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcagctttgctggtggaacatgggattgggaatatttaggatttgcatcaccagaggaatatgctgaatttcagtatcggaggaggcacagacaacgtcgtcgaggagatgttcacagtctactcagtaatcctccagaccctgatgagccaagtgaaagcactttagatattccagaaggcggcagcagcagccgcaggcctggcacatccgtggtaagttctgcatctatgagtgtgctgcacagctcttccctgcgtgactacacccctgccagtcgctctgaaaaccaggactctcttcaggctctgagttccttggatgaagacgatcccaatatacttcttgcaatacagttatcactgcaagagtctgggctggccctcgatgaagaaactagagacttcctcagtaatgaagcatccttaggtgcgataggcacttctttaccttccaggctggactctgtccccagaaatacagatagccctcgggctgcattgagcagctctgagcttttggaacttggtgacagcctcatgagactaggagcagagaatgacccattttcaactgacaccctgagctcacaccctctcagtgaggcaagaagtgatttctgtccctcatctagtgatcctgactcagctggccaggaccccaacatcaatgacaatcttctcggcaacatcatggcttggtttcatgacatgaaccctcagagtattgccctgattcctccagcaactacagaaatcagtgcagattcccagctcccctgtatcaaagatgggtcagaaggtgtgaaggatgtggaactggtgctgccagaagattcaatgtttgaagatgccagtgtcagtgaaggtagaggaacccagatagaagaaaatcctttggaagaaaatattctggcgggggaagcagcatctcaagctggtgacagtggtaacgaggcagccaacagaggagatggttcagatgtttcaagtcaaacacctcaaacctcaagtgactggcttgaacaagtacatttagtgtgaactgcacacatctgggctctaaatgaattacaggtacagatggtatgctaggtggagtatgcttgatagagactttgattcacttaattccaactcagtgataaaccactgacattagggttgaatacagagaagttcccttgaatggtagcttcattttttattttaacctacggatttcttctactggtgatagctttgtccccctttaacgcctgcgggaacgacggcttaggaaacgg

SEQ ID NO: 13371 - DNA, 764 bp, Homo sapiens
tttaatagttcttaaagtatctatttattgaaaggagagatgtccatgatgttaagtagaaaacgaaagctgactacgttagggcatagatatgttcatatgctggaccatgttcacatgtgtatcaaaacatcacattgtacatctgaaatatatgcaattttaaaagctgaaaaagagtatatattgtgatttctattttttatattaaaagcgtacaagttgtttgtatagagaaaacattctgatggacatatatccagcatggtaacagtggctatcactgggtgtgttttggaggcgatcctttttttcttttgtattattcactagcattttatttctattttgcaatgagcatgtattttataaacagtagaaataaaactattttttaaaagatgccaatgtgagagggtcaggtagatattattggcctcaataggtagactttggagcctgacagatcaacagtgacatgcagcaaagcacataacacagggtggttcctgattgcagggcagagggcgctactttctgcctgacttttatctctcaccagacgtttgtggtcatgtctcctcctgcattatatggaagttaaaggaatgtcagaacctggtctgctaaatggaggattgctatgggctgaattgtatcctgccctttcaaattcatatggtgaagtcctaacctacagtacttcagaatgtggccctatttggagataggggctttatagaggtgcttaagttaagatgagt

SEQ ID NO: 13372 - DNA, 119 bp, Homo sapiens
tttttatttttattttttggttcccctctcagccttatcccattttcgaagtctcataatctggacatcatagaaaaaggatgactttaaaagacagattcataattgcaaaacaatag

SEQ ID NO: 13373 - DNA, 441 bp, Homo sapiens
gagtgaaatctcctgaattttaatgagtttgtttgcatacatgaattcgaacaatacattaaatcttaaaacatggtagctgattttaatggagtaaattacccaacttgaaagttagtgaataggtttttctttccctaataatcaagatgctgcttccatctcaaaaaagtcattaatcatacttttacagtatcaatacatgctgttagtttctttttcatctttaaactgtctcaagagatttaggaaaagaaatgtgcataagtgagcataaagtgtgatttcctccatttaacactttttcttatacaaggatgagggctgggtgcagtggcacatgcctataatccaagcactttgggaggccgaggcaggaggcttgcttgagctcaggagttagagaccagcctaggcagcatagggagacctcatctctac

SEQ ID NO: 13374 - DNA, 683 bp, Homo sapiens
ttgatccagtgcttcttagtgtgtgtgtgtgcacacgtggcatctattccagtgcttcttactgtgtgtgtgtgtgcacacgtggcatttaatccagtgtttcttagtgtgtgtgtgtgtgtgtgtgtgcacaagtggcatttaatccagtgcctcctagtgtgtgtgtgtgtgtgtgcgcacaagtggcatttaatccagtgcttcctagtgtgtgtgtgtgtgtgtgagttaatttagtatttatagttgaaccgggcctgggctgtattgctgcttaagttagattcaagacctcacaaatatcaaattaattgaaggtaggattataaccttcccacttgtagtggcttaggatatgaatgcctggaaggtgtgtctattttcctgccctgccattggacttcagcaggctctgtgtgtgtgctgagccttgtgggcgagagcctttcagttccctcatccctttccaaccaagatggacctcttcttggtcctgggtgaggcctagagtgccagtgggaatcataatatttgcctcatgtgattataattcactggtcaattagacaacatataaaaacacctcaaccatctcagtcacgtattaagtgatagctgttattacatctgtggtgattttttaaaactttttgttttgaaataatttcagacatacagaa

SEQ ID NO: 13375 - DNA, 419 bp, Homo sapiens
gacttctgcagagactgaatcatctttatgtcctctatggtagttggcacttagtagatattaaataaaaaacaggctgggcaagatggctcatgcctgtaatcccagtaatttgggaggctgaagcaggtggatcacttgagctcaggagttcaagaccagcctgggcaacatggtaaaatcctatctctacaaaaactataaaaagtagcgggatgtggtggcatgtgcccatagacccagctacttggaaggctgaagtgggaggattgcttgagcccggggggtggaagttggactgagccaaggtccagctccagcctgggccacagagggagaccctgtctcaaaacaaacaaacaaacaaatctctttaactcccaaaatggaaagttctccaagatatatgttaagtgatt

SEQ ID NO: 13376 - DNA, 392 bp, Homo sapiens
tcctactcactagtttatttatgcatgccttaatatagccagcatttagtgagtggctaatttgccaaccaaagatgactaagacatagttgttctcaagtagttcacacattgatgaaggggcaaactggcctgaaacaagaagcaataatatttatagagtaaacatagttgtatgcataagttttagagaagcacaatggaaagacagcctaatgcttggttctggactacagagcggtgattctagttaggcaatctgagatcttgaagacatttgttgaagaagatgtgaaacaagttttttttattgttgttaatttttggtgttcctatgcccaaagcttttgagacagtgaaattgattattttggtggttccagaaggcaccc

SEQ ID NO: 13377 - DNA, 710 bp, Homo sapiens
tgagttctaaccatttttttgtgtgtgtataatgccattctcttcctctgtgaagtgcctgttcggggtgttgctacgtttttgttttgttgtgttttctgttgtagtgtttacatttttcttgtcgattcctaagaggactttagggtactgagtcacccatggtcatgtgttgcagagaagtgtcacagagtgaaaactgtcttttccttgatactacctttagattcatatttgggaagaccttcgctaatcatgactacataagtattcacttttactttcttaagacctttttgttttcatttctttttatagtaatgtctaagccatctggaatttatgtttgttgattatgcaagaaagggatcgaagtgctttttctgagtcattatccacatgccgaaacatttattgaatagccctttccttattgatctgaaaacaccttcttataaaaccttgcattggtttttggacttgctgtgctttcaggagtcagaagaacattcttttgattattgtagctttacattaataatacattttggccgggtgcggtggctcacgtatgtaatcctagcattttgggagactgaggcaggcggaacacctgaggtcaggggttcaagaccagactggccaacatggcaaaaccccgtctctacaaaaaaaaaaaaaaaaaaaaattagctgggcatggtggtgcc

SEQ ID NO: 13378 - DNA, 408 bp, Homo sapiens
tcttaccggaggcaaattctgtgtggttgccggctttcatagcagcttcagaggcaggcccatgagagacgagcgaattttcagggtattgagtgccttgctacattcacactgtatgtgccgttcaagattactattgaagggaaaatcacaaggtattggtttttaaggagggtattcgtatttaaggctatttgctgtaggaattaccttctacagagtttgaactctgttctgaaaagtctgagagaaatagaaacagttcataggaaattttgaagtttggctagcctgtaaaccacaggcttaacagtgctctaaagtcagttctgagactttgtaactcttgatacataattatgaatgcatttttgctttgttgattgttccaataaacagaatcagtgg

SEQ ID NO: 13379 - DNA, 504 bp, Homo sapiens
aagtttttccccagagttgtccatactgttttacattcctaccagcaatgtccgaataatctggtttcttcatacccttgctagccattggatgttgtcatttttttattttagccatttttatatgtgtgtagtaatacctcattgtggttttaatttgtatttatctaatggctgttgatggtgaacatttttttcatgtgcttatttgtaggagaggctttttaaaaattataaatttcaagcctttttttctgattatgaaaaaatactgtatatatcataaaaatgtacgcaaggaaaaaataaagattgctatgattctgttaccttcaggtaatcactgttaaatttggtgcattttatcctaacctgtaaagttatgttatttttaaaaacaaaattgagattataatgtttatattacttgtaaattttttccatcttaatatgttagccttttcagtgccattaaatttggccatatgtaactgaagcttaaga

SEQ ID NO: 13380 - DNA, 460 bp, Homo sapiens
aataactgaaagagtgtatttggattgcttgtaacacaaaggataaatatttgagggtatagataccccattcttcatgatgtgattattacacaccacatacctgtatcagaacatctcatgtacccgtaaatatatacatttattatatacccacaaaaagtaaaaaaaaaattttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttc

SEQ ID NO: 13381 - DNA, 432 bp, Homo sapiens
ccactgcactccagcctgggtgacggagtgaaactcttgtctcaaaaaaaaaaaaaagtttctggttagatttttcctctaggcgcaatctgaggagaaaggaggaaagcttggagaggaacacagctatgaaatgcatccatctgcccctccttcgtcatcaggcaatggcacaatctgagccaggaatgaccctctgtcttccaaggcctgaggtgcagagaagagcaaccaagcccacataatcttccagggttccaaccccagtcctgggtataagaagcaagctgttgccttatatgtgttaaaaagaagagaggggctgggtgcagtggcttacgcctgtaatcccaacactttgggaggctgaggcaggaggatcacttgaggccaggagttcaagactagactacaaagtgagaccctgtctct

SEQ ID NO: 13382 - DNA, 2126 bp, Homo sapiens
cactggggatttaaagagctgccacttccttaggcctccagagggcactgggaagtcacagctgctgagggaccactctgctcccccgcctaagccatgcacctctgtgggggcaatgggctgctgacccagacagaccccaaggagcaacaaaggcagctgaagaagcagaagaaccgggcagccgcccagcgaagccggcagaagcacacagacaaggcagacgccctgcaccagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttttctgctttgcctagttactta

SEQ ID NO: 13383 - DNA, 897 bp, Homo sapiens
cactggggatttaaagagctgccacttccttaggcctccagagggcactgggaagtcacagctgctgagggaccactctgctcccccgcctaagccatgcacctctgtgggggcaatgggctgctgacccagacagaccccaaggagcaacaaaggcagctgaagaagcagaagaaccgggcagccgcccagcgaagccggcagaagcacacagacaaggcagacgccctgcaccagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttttctgctttgcctagttactta

SEQ ID NO: 13384 - DNA, 1953 bp, Homo sapiens
gaggagaccggaggtctgagctgcagccactacacaggcctggaattctaccacagggaatttgcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttttctgctttgcctagttactta

SEQ ID NO: 13385 - DNA, 2171 bp, Homo sapiens
cactggggatttaaagagctgccacttccttaggcctccagagggcactgggaagtcacagctgctgagggaccactctgctcccccgcctaagccatgcacctctgtgggggcaatgggctgctgacccagacagaccccaaggagcaacaaaggcagctgaagaagcagaagaaccgggcagccgcccagcgaagccggcagaagcacacagacaaggcagacgccctgcaccagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttttctgctttgcctagttacttactgattgccaggacgagcacacaggtgtaatcggggcgagctcga

SEQ ID NO: 13386 - DNA, 426 bp, Homo sapiens
cacaaagacacacccgcggggatgaggaggttgtcagtgattgaagggacacactactacttgattttatggaagtgggcgaaaacaatcaaagggaagtacattccctgccctggagtagtgaagtgtaggctgggagctcttcgccgccaaccctggctttgcctcaggcaccgaactttccaataccaagatattaacagatggtggtgagcacatggagggctgctacttacataatctagccactccgcccggctgcccagagcccggcgaggaaccggccaggccgcgcgcgccttccgaggtgtgcttcctgacataacttgcctttctccaaccccacccatcgttttgagggttagcatttggagaggccgtgatttaaaaaaaccaaacaaaaacaaaaacacccaaaacattgat

SEQ ID NO: 13387 - DNA, 709 bp, Homo sapiens
aagtagacagtttctaacagaaccatttacagtgcaacataaaatacatttacgagcagcctccccacagtcctgagggaaagtaccccagaccctagaattctttatcattcacagtgtcatcaagagggaagactctgtcacagcttcccaccctgagggccttgcgtgagccacaggtgctgagagatttttcctctaggcccccggctggccgtgtgggggccaggatggccaggagttctgccccatcacttctgtgtgcagttctgttccatcacttctgtgtacagaaagccattcctgtctaccccagagtcccattcacatatgttcactgcttgtcatgatacggagataggtgcactgaagtgaatacaaatattttcagacatctataagaacagaaaccttgcgaccctctgagtaattaaaggatgtatcccaatacgaaggcagatgaacccagggatccagggtgaaagcaacgtctgccagcaacatgacatgttttgctgaagttaaggtgtcactttttaaaaaaattaaaaatctaaaatttcagatgtgtgtgaaggagaacagagagaaggggagatagactttaactttagtctttgtaataaaaccttaagttacgtactgagaattaaaatgcaaccaacggtagaatagagatagatgataagactttcaaaccagcagagag

SEQ ID NO: 13388 - DNA, 286 bp, Homo sapiens
cccctaagaagaaaaagtcaaacaaaccttttatggtttcagttcacagacattactgccaaccttgttttaatcaactggttgctcttgcttactggacatctatggtatttcttcaatgcaaaacaacgagcaagctcatctgccaagaactccccccaggaggccagtggaaaagaagccatacttgtaagaattctaaaggaaacaagaactttgtaagggtaaacggagttacttccgaatttccctaagggaatccttattgtgaccgcttcagctgcct

SEQ ID NO: 13389 - DNA, 368 bp, Homo sapiens
ctactactactaaattcgcggccgcgtcgatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13390 - DNA, 1121 bp, Homo sapiens
cacacgccaacacaagaagaagagcgacggggagacaaaccatggcatgatgagccggggttaatggacgaggcagggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaactctccatcttgattgactgccctagttttacccagaatcagctggggatgtggccaggtgcagagccccctgcccattccccctttgcatgcctggggaagctccaggtctttttggaacacgacccttaacacggctcctaagggggtatcaccagtccagttccccaagtgtgtgggggatgagccctagccctactctgtgactctgggtgagggctcctcagatctgtgccccaggggacaggccctcaaagtgccatccgtgctcaggtcccagtgccccaggctgacccacctctggtcagtgagtctcctgtgcctgagtgagggatatcgggacctgggggccctgccgagcacctcccacccactgctagtgctggggctttgtgagtgttccaacttcatagccgagagttggaggacaaggctggggcagggcgaggaacggattgagtcctgcctaagcctcgggacatctaaacagc

SEQ ID NO: 13391 - DNA, 471 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagatggccaggagctaagtgcctttttgtgtgcaaccacttaccctttctctgaaaaacctgttctcaggaaggatctgataaactcatttactctc

SEQ ID NO: 13392 - DNA, 2034 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13393 - DNA, 2064 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctccaaaaaaaaaaacgggggtttttcgggggg

SEQ ID NO: 13394 - DNA, 2906 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaactctccatcttgattgactgccctagttttacccagaatcagctggggatgtggccaggtgcagagccccctgcccattccccctttgcatgcctggggaagctccaggtctttttggaacacgacccttaacacggctcctaagggggtatcaccagtccagttccccaagtgtgtgggggatgagccctagccctactctgtgactctgggtgagggctcctcagatctgtgccccaggggacaggccctcaaagtgccatccgtgctcaggtcccagtgccccaggctgacccacctctggtcagtgagtctcctgtgcctgagtgagggatatcgggacctgggggccctgccgagcacctcccacccactgctagtgctggggctttgtgagtgttccaacttcatagccgagagttggaggacaaggctggggcagggcgaggaacggattgagtcctgcctaagcctcgggacatctaaacagc

SEQ ID NO: 13395 - DNA, 2100 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaagggcctctgaacatgcctcgctgctgccaagggccctaaaccctgagatggaaagttctctttttaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13396 - DNA, 1062 bp, Homo sapiens
ggggcctggcatgagggaggtcccttgagacgaagacttgcaggtctgtcttggcggggcttgtcacacctcagcgtccagcgaggagtcagatttctgtccccactgagtcctctcggttgcagatgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13397 - DNA, 817 bp, Homo sapiens
tacctctcgggtcctgtactctcgggcctgtactctcgggccaggacattggagattaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13398 - DNA, 1730 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagtgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13399 - DNA, 732 bp, Homo sapiens
cttccccttccatccctgacaccccattgacttgtgctaacagctctttgccccacaggtgtgacaagccccgccaagacagacctgcaagtcttcgtctcaagggacctccctcatgccaggcccctgcctctcacagcagcaccctttcctctcattgtccctgttccctttttgcctgtggatctgtttggccaggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 13400 - DNA, 1566 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggatagaggctgcagtgagctatgacttgggccactgtactgcagcctgggtgacaagactaccccgtggtctttaaaggaaatatatataaagtcatatcctttgtacattgctcgaaccacgtagtatctctcacatcgtt

SEQ ID NO: 13401 - DNA, 1522 bp, Homo sapiens
gagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgaatggtggggaggagcctggccctacggcggagggccacggtgtactgtgggagaccccatcgtccccgtgtgcacacactaattggcctgcaatcgcgcagtccacccagaacgcccccatccctgctcatgcagattggtctgagccaaccgtgaga

SEQ ID NO: 13402 - DNA, 1217 bp, Homo sapiens
ggacccaatgattggtatgaggtggagggaaggttaatggttgatattgctagggtggcgcttccaattaggcgcatgagtaggcggcctgcagtaatgttagcggttaggcgtacggccagggctattggttgaatgagtaggctgatggtttcgataacaactagtatggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaactctccatcttgattgactgccctagttttacccagaatcagctggggatgtggccaggtgcagagccccctgcccattccccctttgcatgcctggggaagctccaggtctttttggaacacgacccttaacacggctcctaagggggtatcaccagtccagttccccaagtgtgtgggggatgagccctagccctactctgtgactctgggtgagggctcctcagatctgtgccccaggggacaggccctcaaagtgccatccgtgctcaggtcccagtgccccaggctgacccacctctggtcagtgagtctcctgtgcctgagtgagggatatcgggacctgggggccctgccgagcacctcccacccactgctagtgctggggctttgtgagtgttccaacttcatagccgagagttggaggacaaggctggggcagggcgaggaacggattgagtcctgcctaagcctcgggacatctaaacagc

SEQ ID NO: 13403 - DNA, 146 bp, Homo sapiens
tggggtatcccgagccctttggagcctggtcttagtctctggtctccaccctgataccctcaatcaggaggcacagaaagcatcatctgcaaccgagaggactcagtggggacagaaatctgactcctcgctggacgctgaggtga

SEQ ID NO: 13404 - DNA, 787 bp, Homo sapiens
ctctcttctgaggcctctctccttggcctgctgatggtcaccttcttgcagtgccctcatgtgatttttcctctggctctgtctgtgtcccagcctcctcctctcataaggacaccattcaaactgaattagggtccactgacatgacctcattttaccttaattaccactctaaagtcttttcttcagatgcagtcatgttctgaagtactgagggttagggcttcaacttacgaatttggtgagttcacagttcagcctgtaacacatttcttcaggatttccagagcgtgcacagttttgagcagaaaaacgcactgctggaggaaaaggagagaactggaaaattccagcaagctgtcatagacttgatctgggggaggtggggccccactgagaaagatgacaaggtgaacaaagatcagcaagtgattcggtgcacccagcaaacttagaatagatttacttcaagaaattcataaatgaaaaaaaaacaaaaaaacaaaaaaaaaacttgggtttcaaaaaatttctattaacttgctttataaaaagatttcataacagggttcctttaaatacccagccgcaccagtatacttaacaagtgatttgatttaataccatgtgattaaagtactacgtttgcagagcctagccattaaaagcaggacagacaacctgtaattaaaattttgctgaaccctcctcctccaaagaccagttcagttcgcagaggttgatggtgaaagcagccgaggcacttcaactttgctccccagtgtct

SEQ ID NO: 13405 - DNA, 486 bp, Homo sapiens
ctctcttctgaggcctctctccttggcctgctgatggtcaccttcttgcagtgccctcatgtgatttttcctctggctctgtctgtgtcccagcctcctcctctcataaggacaccattcaaactgaattagggtccactgacatgacctcattttaccttaattaccactctaaagtcttttcttcagatgcagtcatgttctgaagtactgagggttagggcttcaacttacgaatttggtgagttcacagttcagcctgtaacacatttcttcaggatttccagagcgtgcacagttttgagcagaaaaacgcactgctggaggaaaaggagagaactggaaaattccagcaagctgtcatagacttgatctgggggaggtggggccccactgagaaagatgacaaggtgaacaaagatcagcaagtgattcggtgcacccagcaaacttagaatagatttacttcaagaaattcataaatga

SEQ ID NO: 13406 - DNA, 412 bp, Homo sapiens
tatctaatagatgtctcaaacctttaatgcgcctaagcctgaactcctgatcttctgaccataagcttgcttctccttagttttcccctactggttggtggcatctctgcccttgtgattgcttgcaccagaaatcttagaatcatttgggactcgcctgtcttacctttcatatctaatttgttagcaaatcctttcaaatttgatcttcaaactatattcagaatccactcatttttcatcagctctgttgcttcctctgttctgagccaacatcttgcctaagtttttgcaataaattccttacaggtccccttgtttctgccctttacagtctacagtgtattttcaacacagtagctagagaggttcttttaaaatatgtcatcccatgggaggctttttattaaga

SEQ ID NO: 13407 - DNA, 780 bp, Homo sapiens
ggattctttgtgccttctctgggtcttaattctcatctgtagaatggagatgatacctactcaaaggttgtattttaaaaattaaatgagatagtgttttaagacacttatcctagcttccaacacctcgtgggggccgcagtaataggtggtggcattgtcatgttcttttccacgctccgaagtctgttcacccttagaattgccctttgtatgccacaatgctagttacgttagtacaccctccaaatggcataatgagtgcttgtcagatgcttcacagattgtcaaatatgtgcccactgtctatgtctgcttggaggaaggagagtcagtgaccaaggagaacatacggaggtgacggcgattttggccgtgagagccaagtgtgattttggtgttgctgcaactcctttgcttagtgcagcagatgtgttcttgatcaaaaagttggactcaaatgcactgtaaattactttgtgtcttggaacgctgtaggggagcttattggttagaaaaatcctgcagtaaatctttctgtagtgtaaatataattcatttgtttttataaatccagaatgttttacattcttaaattctggcacatgtactcatgaaaatgacattgttaaatattatggttgtgaaaaacataaataagagatttactccccagcatagccaggttacagtgagaagaaatttatacactgtggactgagtactgttaccttaagaacctcaatactaccttaattgggcatgcccgtaatttcttat

SEQ ID NO: 13408 - DNA, 2275 bp, Homo sapiens
ggggtgggggtggatggatagatggatggatggatggacggatggggtgggggaaggaaggaaaggagggagaaaggagggaatactggctccatctttgagagctctggtgggcagggcagaaacaggccacagtgctcaacccggacaccctcacgaagggtcgcaagtcactcttgtggctcagattgctcttaggacctggagggacagaccagaatcagggtcccctcctttacccctgagttccttactgttcccccaagcctgggagcagtctatcccccaaccctgccatctcccttactcatccctcttccacagcttcccctttctagccccctctgccctacctgtctttcctgagtgtttgaggggagagagagacccacatctccccaaagagatgagcttttggggcacaacatcccaccgcagtccccctcacccgacaacacctcctacctggccccttgccaaatcccaagcagaattagcaacaggaaaagcagagccccaggagagacactctactatatatactcttctatatattctgtttctattgtatattcactctgtacatgtgggtgtaaatgctgttaaatgacaaaccaatattatactgtggctggtggactattttcatcctcagtgctgtacagatctattttcattgtatatttgatatatttttaattttgtagcgtgtggctgggccaggccccagcgggaggggctgagctggggctgtgtgcttgctaggtgtgggcgcgctagtgctcgttgtagccttttgctgtgtcttcgctgtgtgttagacgtagggcctagagctcggggtgtgtgtgtgcgtgctgtgtgtatggtgtgcacatacgtgagtgtgggtgtgtgtagcgtgctgatctgtgactcccagtgttcaccaccttcctgaagaccacgctccctccccctgcctcctcctcctcctcttggctctattgggagcctcagggccggcagggtgcttcgggagccccctgctacggggaaaggcatgtgtttcttgctggtgactcattgccttcacaccactgggtttgccagaaacagggaaggagggcgttaagggaaaaaaaaaatcctcaaatttatttaccagtcagcttcttgctgttcccagtagaatcgctagctcttctccagaggaaaagtactaggattcttaagatggcgagaccccaagagggatctcatagcactgctgcatttgccgttgacgcagtcctgacagtgtttgaaaagggccgcctgccccctccccactgtgcttttgatgcctttggagtcaaaggcaggtggggtcacctgatgagctaagatccagccccagaatcctggaggagcaggaggtagcaggagaggaccaggtccccaagtcccttcacagggtccccacccccactggctttggtgctgtccacacagtgcccaccagaaggcagagggaactccagggcagggatgtgcctgaaagagtcaacagtcccctgatcccctacctctgcctgccctccagccccatcaccagcttcttgctcagggagacttccgccctcctcactgaggcaacatgaagcccgaggcccagatgggggctgaacaggtagggcacatcagttaatgccagtgaggtcagcttctgccctccagcaatacatgtgcaggggttgctgctttcccagtgccaggagaacccccgctccgagtcagcctgtgtgggtcatgaggctggggcccaggagacacggtcccaggcactgcacaggcctgcagtattaccaggcggaggggctgcttttctgcccttcctcacccccacgccccaccccactcccccagagtactccccactgtgaaaagagctggaaactaaactggttagaatgaacctggctccctgagcatccctggatccttcaaataggccctgagatgtgaggtctgctgcttcactggggcccgatgactttggctgggggagggggcctagggcctcttctcattgaaagctctgctttatacagacccaagcatacacaccaggccgtcactttgggttctggcataagttcagaacaattcaagtccatgtgtcccatggctggtcagagccctgggtcaaaaccactcagcccaggggaggggatgaggcattgtcaccctagacccctcttcctctctcccccaccatagtgtgcaataaagtgtctgttcttaccaaaaaaat

SEQ ID NO: 13409 - DNA, 2082 bp, Homo sapiens
ggggtgggggtggatggatagatggatggatggatggacggatggggtgggggaaggaaggaaaggagggagaaaggagggaatactggctccatctttgagagctctggtgggcagggcagaaacaggccacagtgctcaacccggacaccctcacgaagggtcgcaagtcactcttgtggctcagattgctcttaggacctggagggacagaccagaatcagggtcccctcctttacccctgagttccttactgttcccccaagcctgggagcagtctatcccccaaccctgccatctcccttactcatccctcttccacagcttcccctttctagccccctctgccctacctgtctttcctgagtgtttgaggggagagagagacccacatctccccaaagagatgagcttttggggcacaacatcccaccgcagtccccctcacccgacaacacctcctacctggccccttgccaaatcccaagcagaattagcaacaggaaaagcagagccccaggagagacactctactatatatactcttctatatattctgtttctattgtatattcactctgtacatgtgggtgtaaatgctgttaaatgacaaaccaatattatactgtggctggtggactattttcatcctcagtgctgtacagatctattttcattgtatatttgatatatttttaattttgtagcgtgtggctgggccaggccccagcgggaggggctgagctggggctgtgtgcttgctaggtgtgggcgcgctagtgctcgttgtagccttttgctgtgtcttcgctgtgtgttagacgtagggcctagagctcggggtgtgtgtgtgcgtgctgtgtgtatggtgtgcacatacgtgagtgtgggtgtgtgtagcgtgctgatctgtgactcccagtgttcaccaccttcctgaagaccacgctccctccccctgcctcctcctcctcctcttggctctattgggagcctcagggccggcagggtgcttcgggagccccctgctacggggaaaggcatgtgtttcttgctggtgactcattgccttcacaccactgggtttgccagaaacagggaaggagggcgttaagggaaaaaaaaaatcctcaaatttatttaccagtcagcttcttgctgttcccagtagaatcgctagctcttctccagaggaaaagtactaggattcttaagatggcgagaccccaagagggatctcatagcactgctgcatttgccgttgacgcagtcctgacagtgtttgaaaagggccgcctgccccctccccactgtgcttttgatgcctttggagtcaaaggcaggtggggtcacctgatgagctaagatccaccccatcaccagcttcttgctcagggagacttccgccctcctcactgaggcaacatgaagcccgaggcccagatgggggctgaacaggtagggcacatcagttaatgccagtgaggtcagcttctgccctccagcaatacatgtgcaggggttgctgctttcccagtgccaggagaacccccgctccgagtcagcctgtgtgggtcatgaggctggggcccaggagacacggtcccaggcactgcacaggcctgcagtattaccaggcggaggggctgcttttctgcccttcctcacccccacgccccaccccactcccccagagtactccccactgtgaaaagagctggaaactaaactggttagaatgaacctggctccctgagcatccctggatccttcaaataggccctgagatgtgaggtctgctgcttcactggggcccgatgactttggctgggggagggggcctagggcctcttctcattgaaagctctgctttatacagacccaagcatacacaccaggccgtcactttgggttctggcataagttcagaacaattcaagtccatgtgtcccatggctggtcagagccctgggtcaaaaccactcagcccaggggaggggatgaggcattgtcaccctagacccctcttcctctctcccccaccatagtgtgcaataaagtgtctgttcttaccaaaaaaat

SEQ ID NO: 13410 - DNA, 548 bp, Homo sapiens
taactacaaatacaagatgattttctggactactattcacccagttgctatctcatttagattcctgtatctaatccagtagcaaattctgtaggttctgctttcaatatatgtactaaatcagacactttcccccctgtctttcaaacctctgttcacttccatcatttactgcctggcctcctgtattagcctactttggagcagcagctagtgttatcttcttaaaatatagaccatgttactcccctgctaaaaactgtagaggttctccatcacacttacattagaatcttgccttcccccccaccccttagctataaggccctgcattcatttgggatgcctacttctgagcgcatctgcacttctctctctgggtcactccactgtagccacactgttgctttgctgtaccctgaacaataagtggttgagcttattccagtcacaggactttcctccagtttgttgcattgcttgctttgtccagttgttccgttcttagctcatatgtcataccctctacctaacctgtcccgtataaa

SEQ ID NO: 13411 - DNA, 511 bp, Homo sapiens
cctacctcactggtttggtaagagaattacaggatgattcatgtgaagcactttgcccagtgagctattactgaaaaccccataatcactctaccttctctgtaactggtttgtgatatatgctttcaagcctttctctgtgcatttatatacatagataggtatatatagaaatacgtcttttttaaaaaacaaattgtatcatatatattattctatgatatgtttttggttttttatttgtctgtcttagaactttctaatgccttctattagggtcatcttcattctgaggcatagtattccagatgtgggtgtatcacagtttagcttccctctactcatgtctatttaggtgatttctcattattttatgaccataaatagcattatagggaacatccatgcatatgtctgttggggcacctatgtgagtgtttctccaggttcaatacgtaaaagtagaactgctgagtccaaaccacacctttttaaaacctcatccttaggg

SEQ ID NO: 13412 - DNA, 419 bp, Homo sapiens
  misc_feature (349)..(349): n is a, c, g, or t
  misc_feature (353)..(353): n is a, c, g, or t
  misc_feature (355)..(355): n is a, c, g, or t
acccacacaccacactttgcacaagtctcaccttctaagatcttccttctctccctgccccagcccagccagccccaaactctcatcctcaggactacccatggcagtgactcgctgtcttggacttgtatcttagaagaagtctccaggacaatccactttgtaaatgtggatttttcagaaaagtaaatggtactttttctggccaggcacggtggctcatgcctgtaatcccaacactttgggaacccaagggaggcggatcacctgaagtcaggagtttgagaccagcctggccaacatggtgaaacctcatctctactaaaagtacaaaaaaaaaatggcaagngcgncnggtggctcacacctgtaatcccagcactttgggaagccaaggttggcggatcatgagatgagga

SEQ ID NO: 13413 - DNA, 434 bp, Homo sapiens
gagatggaaagcccagaaccagtccctttaatgcacttatttgcaaaacaagatgtcactatgcagcagagtgacagtcctttcccctggaactgtcccagagttctccaagctgaagccagggctacattcaccatctcagactcctgctgagctaagtaaccaccctctcctaccttctcttcaggagccctggcacccttgctctggggagagtttgaagagcaacctgaaagttcccacagtttttcctcaaatctgggtttccatgagcatgggccaccagtcgggagagccacatgcctgcccttgcctggctcaagactgtcactctgtcagatttcatattcgctcttctggacccttaggccttccagtctgggatctttggaccttgaactggactctgtaggaagttcttaacattaaaggaa

SEQ ID NO: 13414 - DNA, 360 bp, Homo sapiens
gattaacaagagaaaaccattaaaaaattatttaacaaagttttccatgacaagggagccctcagaaatgaggaccaaagacccaatgaaaagtatgtatttttaggcttggattctatggacaagtcatgtagaagtatgattggacaataagtatattatctagtgctaataaatgggcactggggagcccagaaatggctgtctgttcagattcttttggcctctgggtaaagaagtactcctctggaataagggctttatgccctactttcaggggaggtaggtcagagcattcctttatggccagctgccacacagaaaggcatagtgattgtggtaatactgaccttcttgctt

SEQ ID NO: 13415 - DNA, 751 bp, Homo sapiens
attcggcacagcggtataaaatatatagcatgaaacatgcctttagtctgaatgtattgttgatgttcagggtgattagggtaaaaaggagaaagctgaagagatatcctgataatataatccttcctgcagcaagcctgctttaggagtacatcaaggaatttctaaagaaaacaacacgagcctctcattccttgaatgtttgttgcttttctcttcatttttgtttttgtttttgagacagagtctcactctgtctcccagggctggagtgcagtggcatgacctcagctcactgccacctctgcctcccgggtttaagtgactctcgtgcctcagcctcccgagttgctggggattacagttgtgtggcaaccacacccaggctaatttttgtatttttcgtagagatggggtttcaccatgttggccaggctagtctcgaactcctgacctcaagtgatccgagtgctgggtataggtgtgagccactgcacccagccttctcttcatttttgaatgtgtttttattttcatgctcacttactcaactctctctaaacatgcagatatttaagtgtgctttgacagctgggtgtggtggctcactcctttcatcccagcactttgggaggcctatgtgggaggatcccttgagcccaggagtttgagactgttgtgagctgtggttgtgctgctgcactccagcctgggcatcagagatcctgtctctaaacacaaaaagaaataa

SEQ ID NO: 13416 - DNA, 387 bp, Homo sapiens
actgcttgaacccgggaggcagaggttgcagtgagccgagatcacaccactgtactccagcctggagaacagagtgagactctgtctcaacaacaaaataaaaaaggtcatacttcctcaataaatgttgaccattattagtcgtaaatgaattttagtttagttccatgatttgtggtcaaggatactgtaagcaaaataactcctcatataggaaaaaaaatcttaactcagtatattcagagaatcaaagttgaaaatgctatatatgaatctgttctaaccacttctagaaattggagctctaaaccatgtaaatttcctaaaacaagtacatttcctgatgtgtgtataaattttcccccatgtaactaatattggtatcct

SEQ ID NO: 13417 - DNA, 156 bp, Homo sapiens
gacacagtgagactccatctcaaaaaaaaaaagaaaaagataaaccaggcacagtggttcaagagttcaaggatctcttaagccaaggagttcaaggtttcagtcagttatgtttgcaccactgcatgccagcctaagtgacagagcgagagcttg

SEQ ID NO: 13418 - DNA, 862 bp, Homo sapiens
gattactggattttgtccagtgtgaaatgtcttcattgtcctctgtatatcctcagtttcctttgacttaatgtaaacaaagactagatgctgtcatgctatgagtcctagctggatttgcagtatgtcttcatctaaagtttccagttgatatcatcgctagcctcacaagataagcctatagttggttacattttacttcctaaagggaattttaattccttgtcccttaaggatctcaacaatattaggcctgtattacctggaaaaagtaattttctgttgtttccccaaaactctgacttaaactccgtttggttcacactcctaatgtcttctcttcatgatactattgtccctacagctttacatttcattagggtgtgctttccttccccacataacacattctttaagtctgacctcaaatcttcaacccctccctgacttttgtcatgacttctgtatctcccttccctcgacttcagtttcacctaggggtgataggataaagaagtgactctgattaagtaatctgttattcgatagtgtctatattttgcttgagctgttttgctcttggatcatagtcctgtaaggaaaggggcatgttatcccttgatgtagtgtgtaacagagagagatatttctttctttctttgattatctgagaagctaggcaggtgaaagaactttcttgtccatccattcagaaataatttacaggcagttacttctaaatatgcatgcctgggccaaatgtggtggctcacacctgtaatcccaaccctgggaagctgaggcaggaggattgcttgcaaccagcctgggtaacatagtgaaaccctgtctctacaaaaaa

SEQ ID NO: 13419 - DNA, 509 bp, Homo sapiens
tctggccttttaataggaagtaattttggtctagaaatgcactggagcctgtgccctggtagctggaaaggtgctctagagagtggtgaaatgtagcctgccaccaggctctgcctggagtgtggattctggacatccttcccagttggggaaatgggccctggaactattctttgatgtagtatgtgtgtttactcctacatgccccagtccttgaagggtagcttaagaaacccagccagtgaggccaaagtgcttgttctaccaacagagtagtaggtgggggaaaaccccaaagattgctatccacactcctcttctttggtgcctggaaaaacagtactctttctagcaattaacatttgaaacagatatactggcctgtcagataaatcagtggcttagcattgttttgtggtacaaattctggaaagagttgtttattaggaaaaccttcttaaaaaattgtgagatgaccatagttctccctctctaaatgccagattaaa

SEQ ID NO: 13420 - DNA, 2818 bp, Homo sapiens
  misc_feature (29)..(29): n is a, c, g, or t
  misc_feature (608)..(608): n is a, c, g, or t
  misc_feature (1460)..(1460): n is a, c, g, or t
  misc_feature (2135)..(2135): n is a, c, g, or t
catacatctttaggaaagggaggcaggtngaccctaagccatgcagccttgtgcagtgcttggtgttagatggtgcgtgtggcccctgtggatggagatctacctctggtatgtaggcaccaactctggatccgtgcaggatggttatcccagaatccagagcaagggagcagcctgcgtggaatattatgtgagggcagtgccgggtgcggaggacacgttgcagctcccgagccaatagatgccaggttgtgccaggagctcacacacagcaggctccaggggcggtgctgggtcatctccaccaccaaaaggacaaaatgaaaagtctgaatggaggttaacaggctcgattaatattgaactgactttcccgccacacctggatcattctgtgggtctgcagcaatatatttatcacacttcacagatgagctggcaggggtcaatctgccaatgacactggcagttaccaaaacgtgggcagaatgtttgcgtgcttcatgccctgctggagaggagcctccaagaactgactagctgtcccttttgctttgtttttctctaaaaattggtctcactgttttttgtgctcatgttgatatttntagaccttacaaggaataaatatctttgactatatgtacatttcccccttgttttcatgttcaaaaggatcacttcagaatgcaaagtaactgacattttcagaaaatgttattcgtgtttttacctataactcactagcttttttctattaaagtctttatatacatttttattattatgttttctcatgtaaagcataagaaaaatgcttgctagtttgatagtagtctgttatccattaaatcttactgaattttggaagtgcgtggctttatatagaagccttagaagttgctcagactgtatttaagatgacatattatctggtttctgcttgacttttttttttcgggggggcggtggggagaaatagagcatttttcttccataatggtacttctaagacatatctaagcacaaagtgaaaaagaattcaattcttaaactggttctttttttagcgatttaggagaactcagaataagctggggcaagggaaggggactgtcttagtccactggggctgctgtaacaaaataccttagactgggtactttataaacaacaggaatgtattgttcacagttccggaggctgggaagtccaagatcaaggtgccagcagatttggagtctggggagggccattcctcatagatggcgccttccacctgttctcatggggtggaaagggcaggcagctctctggggcctcttttctgaggcactgatgactttcctaagggtggagcctttccagaggccccaccttctaatactatcaccttggtgattaggtttcaacatctgaattttggggactacaaacgttctgaccacagcagggatcanttgattcagtgtcatagaatctctcttaatccttttgaaaatcctttagttagacaaattttaatttgacttcaatcttagtctttagggggtaagtgtaaaaatatgcagcaaaatgctgtcctctctgtctgtctctgtctctgttcgtctccctctctggcacctgtccaggaatgactgcagatggggcagggctgcagctgacttgggagcagccaacctggaggttcttcccccgtgtcccctgatcaaagaacagaagcacctcagcaaccacgccccgtcctggaaagtgttacccccccaaccccagacttctgtttcttgtacccctgtggcttctgctcgctgtcttctccttgtggcagttttcatttcggttgagacagccccagatgggacaggatgggtggggggaggcagaaggcttccaaaaccagcagcagcattacactaggtactcattggcccctttctgtgaccgagttcacactcagaacacacgtgttgaaatcgggaaaaaaacggagacctgttgtatcttgcaaggaaaacgttccttacaggtatatttacagaggactgtgtcacactcaggcagaaatgacctcaacaagacagcctcgtggaaggaagaacacttacctacttaactcccctccccgccccggnctgcctagtctagcctagccgtctataacaaccccagtggactgacattccatcttggaatttatggaggtgacaaaagtgtcatttgagatggaccaaacccagcccttccaagaagagctctgtatgttttatcttgacatgtgttgatgaataatgacctgcacacacattctgaatgcaggaagggaagtcctgctctccgtccatcgccagtcactcactcgggggaggccaggaacttagtagctctcggctctggtctgcatcccttcccctcgggttctgctcgcctcggctgtgtctcacaggagtcagcgcccggcggccgtgtgcaggtgctggggccccaccttagctcaagctctcttaaattccttatggcagaatgaaaacaacttcattagggcctacctgagaagaaaacaaaaacaagaaaaagtgtggacatcattatccacttgtcctggctgccttgcccccttctaaccatttcatgcccattctagtgtgggcttctgagtgctcatttggtttttcatatagtttttaaatcagttgttactgtcaagatgaaaacatatcacagatgttagtagcgcagtgctgagtgcttcttaaacagtattaacttacatgcttgatgaccatgtgttcttgattaacaaagccaacgcaagtac

SEQ ID NO: 13421 - DNA, 544 bp, Homo sapiens
tcgccctctgtgctctctgcagccgccactgggattaaggggaccaggtgtgtctgtggcacctgtgccctcctaggcatctcgccagccaccagctgaacaggtttggtgctcctgggtatctgggaggggctggggacgttcctgcctcctggtgtggcttagactgaaagtcctgcacgtccgaactcagggatactcgaggcttcctggacatagactcacgggcccagagtctggccgggctctgagggacgctgcccggccaggtgccccggcaccctccttccgcattccccaccccccacccctccccctgcatcctccccaaccgaccccagacagagctgggagggcctgagggacactgcccaggccggcaccccgctgcccctccccaccttggtcagcgctgagctgggctgcccagaaatctatgagcctgttaaataatccagattattgttcttaatctcaaaacaatgagtggaaggtgccattatttctctttgcaataaaaataaaagttgaaatacgcagttta

SEQ ID NO: 13422 - DNA, 328 bp, Homo sapiens
taacaaagcatttttcaatctggcagtgcaaacattttagatgatattaaaaattctcttcttcctttataaacacagaaccaaatacaataaggaatgaacttcaagatgtttttaagtatgatataagtaagaggacaaagttgctacaacaataaagacaaactatacaaaatttttattatcatttcttttgttctcctaaagttttacccacacctacaaaaaaagtggtctgcatagtcaaaaaggtaatcacaaagtttccaggctaggttattttattaaaagggatttatctcaccttgggaaataaatcaaaactaat

SEQ ID NO: 13423 - DNA, 487 bp, Homo sapiens
ttagggtctttacagttatgataaagacaaggcgaggccacactggattagagcaggccctaatccactgactggtgtccttctaagaagagggaaatttggacacgcagtcacacaaggagaatgctgtgtgatgaagaaggcagagagtggagtgacacatctttaagacaaagactgccaaagattgtggacaatactggtatcagaaacttctgccaacttcttctgaaacgtctgcctacaaacttgttttctactaaaatcgtccattctatgagaaaacacagaatatgatgaaccattcagccaggaaactgctgctaattcctcagggctgtttacctatgatggcctatatcagaagctaggagtgaggcatagaataatattcctcagagcctccagtaggaaccaaccctagtgacaccttgctctcagacttctagcctccagcactgtgtaagaataaatttatgttgtttta

SEQ ID NO: 13424 - DNA, 447 bp, Homo sapiens
aggatcacttgaggccaggggctcaagaccagcttgagcaacataacgagtttatgtttcatttaacttttatgcaacttcttaaagtttgttaacttactttcttaagaaggaatgttttatggttaacttcatttttgtagtcagtgcatatacactactttagatatataagattagctatcctaggctgggcatggtggcttacacctgtaatcccagcactttaggaggctgaggcaggtggatcacataaggtcaggagtggccaacatggtgaaaccccctctctactaaaaatacaaaaaattgccgggagtggtggcgcacatctgtgataccagctactgaggcaggagaattgcttgatcacgggaggcggaggttgcagtgagctgagattgcgccactatacttcagcctgggcgacagtgagactcagtctca

SEQ ID NO: 13425 - DNA, 748 bp, Homo sapiens
gagggaggcatggaaagacttaaagataagtggagacgactcattgatcaccacaagggagagaattggtcaccttggatctctgggaagggaatatatgggatacttttaggaggggagctagaaaaaaaatgattgagcaaagaagacaaccacggcagaaaggaaccaaagtgattactaaactaagttatttgaggacagtgatcgtatttattttattaatatattcttagcacctagcattgcaaataaccttgcaaatgtttactgaataaatgaatgaatattgattaggatcttatcagattcttggtcttgataagtaatctatagatgtgtgttattttaaataatgtaaatataaatttaatagaaatgtgtattaaaatatatttgcaaaaaagaaatataagctttttcaaatgtggaaaatttagctgaacatggtggtacatgcctgtagtcctagctgccttgggaggctgaggcaggaagattgcttgagccccaggaattcaagactgcagtgagctatgatgacactactgcactcccagcttgggcaacagagaccctgactggtaaaaaaacaaatgtgtatgtatcttttttccgtatttttctgaattcttttcctcctttcaggaaatatattttgtgaattcactttatgatatcagacaaccatataatcaacaaataaaattttcaatgtttgtaagacccttttatttaagaggaccat

SEQ ID NO: 13426 - DNA, 497 bp, Homo sapiens
gagggaggcatggaaagacttaaagataagtggagacgactcattgatcaccacaagggagagaattggtcaccttggatctctgggaagggaatatatgggatacttttaggaggggagctagaaaaaaaatgattgagcaaagaagacaaccacggcagaaaggaaccaaagtgattactaaactaagttatttgaggacagtgatcgtatttattttattaatatattcttagcacctagcattgcaaataaccttgcaaatgtttactgaataaatgaatgaatattgattaggatcttatcagattcttggtcttgataagtaatctatagatgtgtgttgtccagttgtatcaggaagggagtacagtgtaatggttaagtgacctccagaaacaggtagcttggatttgaatctcagttaaaccacttagtagctgtgtgaccttggacaagttatctaacttctttgtgtctcatctgtaaaagaaaaa

SEQ ID NO: 13427 - DNA, 502 bp, Homo sapiens
ccattcccaacctgcccactacacacggtcatagaaaagcctctcatgacctggccccattacctgggcaaactcatcacctctcactctgttcttcagcagttctgaacttgtgcttctcaagaactagtagatcccagaacacaccttacttttttacatttgcatgccctcacccacttctcaagactggtagcccatattgtgcctttgtggaaattaggaaaaggtgccacatccccctcgtgaggctagattccagaccccactcatcccttgactggcaccatactgccctgaccaacctgcatactatttcaacatagcctggagcaaacacgctggtccacccagcaaacccctcctcatccatcaagccacagctcagctgctaccgcctccgtgaagtcatcttcagataccctcacaggtttcgctggtttctctgctaagcttccactgctttttaaacagcctccattaaaacaattatctttttcga

SEQ ID NO: 13428 - DNA, 542 bp, Homo sapiens
tacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctca

SEQ ID NO: 13429 - DNA, 452 bp, Homo sapiens
tggcacctagaaagctctttgtaaatttcccatcactgtcatcacccatccctcatccatggcattaccatgaatgccctgattccgaggagggattggtttcccatgagacatccccatcctatttgaagatgatggtaatatagctattttttccccagttcttgagtttaaaaaaaaaagatggtcaaaagctgagagttgatccttggctaagagtggacctcccttggcagagatgagaacaggagcaaaacagaaggggtcaaatgtgaaacaagactcttaggtttcagtgctgttgagatgagatgccaggagcagaagatccagtgggcattgttgggcagcagtggaggaaggaaggaaggagaggagaggaaaaggaagaaattaataacgccttcttcctagctcctcccaccctgtggttctcaaaacagatcttccca

SEQ ID NO: 13430 - DNA, 456 bp, Homo sapiens
ccccagacacctccttctcatcacctccttaacatacaggaatctgtgtttttaaggatgctgaacccgtgcatcccgtatctctgtctggaattgcacttcaggttccaatccttgctgcagtgaacctggtgagttaattttcttctcatcagtttcagtgactacctccacaaaacacagagaaaatatttacctgtctcatatgttaatatgaggatgaaaagccgtttttccatgtcaagttctttcatggaacaagtgctcaatacatgggagctattatcacgattatcatattcttttcaaaagaaagagctctctcagggtttccatttaaatatttgattctagaccaggagttggctaactacagtctgtgggccaagaccggcctgccacctgtttttgtacagctcgtgagctaagaatcctttccacattaaaagttaaaat

SEQ ID NO: 13431 - DNA, 230 bp, Homo sapiens
tatatatatttttcagcattgcattctttatcctctccttctacagctctaatgtcatgaatgttagaccttttggcattgcctcacaggtccctcggttcatttttttaaaaaaatatgttttctttgttgttcattggatactttcaattgatctgtcttcaagttcattgacttccctttgttatctctattctgctattatcaaacctatcaatgagttaaaaaat

SEQ ID NO: 13432 - DNA, 418 bp, Homo sapiens
attgcatagaaagtcacctttacttcagtttggattaaggtttatagtcttagaatcttgagaataagtgacttgcaagcatgtctaacttttattcatatctgacaaaatattaatggctatctcagggccgaacatcttggtaacatctttgctaagatcgtctatcatttattatggagaatttcagatttatgtaaaagcagacagaagaacatcatgaggtactctttatctgtttcctgcccctagctaccgtcaccacatgactaaactcccatttggttcttggctttaattttcgttttgaagcaaattcaaaactctgcatcatttcatttgtaaatatcacaagatgtgttgaaaaaataggataattcttttccctctacaacataatgacaatatcattatcaca

SEQ ID NO: 13433 - DNA, 151 bp, Homo sapiens
tttatgacagtattttgaattctctttcagataattaatatatctccatttcattagtattggtttccagagttttatcttgttccttttttggattatgtttctctgttttttcattttccttgactctttgtgttggtatctgtgcatt

SEQ ID NO: 13434 - DNA, 365 bp, Homo sapiens
tccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaagtgtaacagcgtttatagtgagggtgattaatggtagtcacagtgtaacagagcacagacagccaggttccagggttgggagggcaaggaagtcaacacagttttatatcatcctcctggctgggaaaaaaaaaa

SEQ ID NO: 13435 - DNA, 336 bp, Homo sapiens
gtttttttagtattccattttttattttattagtatttgattactaggctttcccctatgtcatgtgatgtgagtagccccggaaagagagtacccaatctttgcctagataacttcacaattatccattcttttattcaaaattcttctccagattgattattctggtaaaaatgtaaacactccatagggggttaatacatattatgtaattaatatcctagtataaacttctatcattgtttaatcaccttctcaccctgtataaatgccaaagcacagaataagaacgggatatacctctctacaggatccccattacagatgttttgtgcg

SEQ ID NO: 13436 - DNA, 492 bp, Homo sapiens
cagccacctccgaggatgagacttactggaagggcacatgagggaatgttctggggaatgagaatgtcctggaaataccctctatcttgattctgtggttacacaggtgtctacatttgtcaaaactcctcagccctcacttgtgcatttcactgtaatggaaattacaccttattaagaaaaaaaaatggaaaactgaaagataggtctggaggggctcatgtttcaaggaaaacagaaactgattcctttgtagtgctgaacatactgacgactgggaaagaagacacaactgaagatgcctctgcaaaatcagcccggtcccatccttggtccctgcttacgtttgagtttgagacccacaggttaaggccttgaacgacatcttcaaagatctatgcagaactacgacatccaacatagaagcgccatgagccacatgtggctatttcaatcaaattaattaaaaataaagtgaaaaattcaaccctc

SEQ ID NO: 13437 - DNA, 448 bp, Homo sapiens
taagctcccaagtgattctatgtgcagtggggttgcaaaactgcaggttgaatcttagcttctccaggaagccacctctgattagctgatgctaatctatgagcccagtggaactgtcaccttttctaatcagccagccctgatgtatccatacaattggagggggatggggtgaaataacccccattagtgtgaattggttgaagaggacacagaaggatgtaggatgtaccttctcatttctctgagcttaacttccaaatgaacaagcatttgcagctgctggacagccacaaaatcaattcactcagtcatttaaccaacattcattgagcacctattatggataaagagcaatgagagattcacagcatatttgatatagtctctgtaaaccaaaaataaaattctaagtcccctaaatgacggaatggagcccccctcttca

SEQ ID NO: 13438 - DNA, 395 bp, Homo sapiens
gtcagattaacatgttttgggtttttaaaaatgtatatgtctccacacatagagctatatggagaaaaggctgagaggaattagtccaaaattttaacaagattttgaggctggctgggtgcagcggctcacgcctgtaatccaaacactttgggaggctgaggcgggtggatcacctgacgtcaggagttcgagagcagcctggccaatatggtgaaaccctatctctactaaaaatacaaaatttatctggacgtggtggcacatgcctgtagtctcagctactctggaggctgaggcaggagaatcacttgaacctgggagacggaggttgcagtgaaccgagattgtgccactgcactccagcctgggcaacagaacgagactctgtctca

SEQ ID NO: 13439 - DNA, 447 bp, Homo sapiens
gtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagag

SEQ ID NO: 13440 - DNA, 472 bp, Homo sapiens
ggcctcccaaagtgctgggattacaggtgtgaaccactgtgccttgccgaatatgggtagttttagacatgctcatggcagaatgatcaacaggcggaagaagtgggaggtccagccgatgtggatccctgagagcccatgtccacaaacaggggaagaatagtggctaaaataggtcttgtagggaattttaaagacaagtgaattgtctgttgaggcagccaaaaaggggctggcttctgccaggtggcagccaggcaatgtccaggagaggagattgccaaggaaaggaggctacaaatgccccctccttgtgatgtcaggacctcccttagcgagcgatctggccaagacacagggaaaagacacaggatccagacccggggctctgctccttggacggctcagtgcagagagtcagctggctgcctggaaggagagagtgggcaagggtgtgagggaatctttgggg

SEQ ID NO: 13441 - DNA, 937 bp, Homo sapiens
gaacttccatagtgttttctacattagcggtaccattttacattctcaccaacaatgcacaaggatttcagtttctccacatcctcaccaacatttgctcttttcttgtttttatttttaataggagctctcctaatgggtgtgaggtgatatctcattatggttttggctcacatttctctagcgatgttgggcatcttttcatgtactcactggtcaaatgtttatcttgtttggagaattgtctattcaagtcctttgtgatcatggttttctttttgatgcttgctataattttggtctctttagttggactccggtgctattttcctcagtatatttgatggtctaccacaggggtccccaacccctgagccacagaccagtgtgagtccgtggcctgttaggaactggcctgcacagcaggtggagcagcagttgagtgagcgaaactccatctatgtttacagctgctccccgttgctcacattaccacctgagctctgcctcctgtcggattagccagccttgttagattcctcatatgggagcatgaaccccaattgtgaattgccgcgtgtgtgggatcctaggttgcacaccccttgtaagaatcctaatgcctgatgatctgaggtggaacagtttcatcctgaaaccatacccccatcccaatctgcggaaaaattgtcttccatgaaaccaaccggtccctggtgccaaaaaggttggggaccactggcttacaagatactctattcccatctttagttctcttgccccaaacatagaattaactactctactagctgtgtttgttcttttggtgtaaaaaaatgatttgaattcaaaacatggggttctgtcaaaatagcacagtgaatttgtgaattgatcatgtctctgctccaaataaagaaacaaactacaagaagag

SEQ ID NO: 13442 - DNA, 506 bp, Homo sapiens
ctgctctcctggcatgggtgtgagtcagcacacactgaggtgagagaagaagctgttatattcaggccagatttttttttgcaaaaatctttctttacacgcagcaagaactgggaaggagcccactggagctgagccagcaaaacccaaatggaatccacgttgttggcctcttaatttgtttgaatcattgcagattcccagaactttgatacagaaaagtgctcagggtcgggcgcggtggctcacgcctatagtcccaggactttgggaggctgaggccagaggaccgcttgaggccaggagtttgaggccagcctggccaacatggtgagacccatctccgcaataataaaaataatcagccaggagaggtgttgcacacctatggttttagctactcggagggtgaggcagaaggattgctggaacccaggtgtttgaggctgcgtgagctgcgatcgcaccactgcactccagcctgggtgacagtgagaccctatctc

SEQ ID NO: 13443 - DNA, 770 bp, Homo sapiens
ggaggaagggtacaggaaataccaatagcttacttttttgagtgcttattatgtgctgaatactggtttaagggcttgtacagcaaatccaatgaaatccttacaaattccctatgaggtcggtactattactagcccctttttatggacagaggaatctgaggtataaagagatcttgtaacatcctcagtccttcaagaactacacactccttttaccctcttctctgaaaggagaccctgctctcttcattccccctcttctagcctgtattgctcacttcacacttctaccctcaggcacagagtcttccctcaggcccaggccacagccttctccattcctgccacggcgccctcctcttctcccaggtctgctggcagcctaggtgacttccacactgatgtccatgacccagacagctaccttcacagcttcttgatttcctggtctaaaaaactgctttccagcttatatccaaggctcataattacaaagagctattttcaccactgaaattttaaatattaatattctttttttttttggagaggagtttcattctgtggcccaggttggagtggagtgagcaagatcccacattgattcagcgtggagaaagagcaatttcagtctaaaaacaaaaaaggaaaaggaacaattggtttagtgatagatgattcagaatttgcgggtgagaagcagggggggtgttcattatggttggtaggaacgcagaaggggtgcaggggtattgacctgaagggtt

SEQ ID NO: 13444 - DNA, 465 bp, Homo sapiens
ggaggaagggtacaggaaataccaatagcttacttttttgagtgcttattatgtgctgaatactggtttaagggcttgtacagcaaatccaatgaaatccttacaaattccctatgaggtcggtactattactagcccctttttatggacagaggaatctgaggtataaagagatttaagggccaaggtcacatagatggcaagtacagggccagaactcacaccagtttctgtgtgtatgtaaaatgactgtgggaggcataaactcaccttttaaaaggtgagtcacggaaggaaaaagaggagagtccctttgtttttctgtattatgtacttttgaatcatttttagtttttttctatcaagagcctttccccatctcaaaacattataatggaagtacaagctcaatccaaaaagacaaaaactaaaaatgattcacaagtacataatacgggtaccgag

SEQ ID NO: 13445 - DNA, 1693 bp, Homo sapiens
ggaggaagggtacaggaaataccaatagcttacttttttgagtgcttattatgtgctgaatactggtttaagggcttgtacagcaaatccaatgaaatccttacaaattccctatgaggtcggtactattactagcccctttttatggacagaggaatctgaggtataaagagatttaagggccaaggtcacatagatggcaagtacagggccagaactcacaccagtttctgtgtgtatgtaaaatgactgtgggaggcataaactcaccttttaaaaggtgagtcacggaaggaaaaagaggagagtccctttgtttttctgtattatgtacttttgaatcatttttagtttttttctttttggattgagcttgtacttccattataatgttttgagatggggaaaggctcttgatagaaaatttaaaatttactaaggaacagaaagctctaaaacaaatcactagcctgggcaacacagtgagacccatctttaccaaaaaaacaaacaaaaaactggcccgctgtgctggcacgtgcctgtggtcccagctactcgggaggctgaggcaggaggagctcaagttgggagctgcaggaagctatgatggtgccactgcattccagcctgggtggcagagtgagactctctcaaacaacaacaaagaaagcattaaaacaaaacaaaaacccacctcattcagggcaataattactattttgatttttcagctcacagacctacattctgcagtcttgtgtatttgagcttacaatggtacccattaaatttggctaaaacacttgggttgctgttttccctaaagaaacactattaagtcacatccccaaaacttacttagtggtcatgacgcatattagtcagtgtactgaaaattaagtattctggcccattaaaatatataaaaaattttaaaggttgtttctgtgcctgtggcatcttttattatctaattaactaaggatcttttaaaaaatctctgaattattttttgaactatcattgccatacaggtttgttttcttcaaccctatcggccctcctgagtctttctgtgctccggatagctcttttcttgtaacatcctcagtccttcaagaactacacactccttttaccctcttctctgaaaggagaccctgctctcttcattccccctcttctagcctgtattgctcacttcacacttctaccctcaggcacagagtcttccctcaggcccaggccacagccttctccattcctgccacggcgccctcctcttctcccaggtctgctggcagcctaggtgacttccacactgatgtccatgacccagacagctaccttcacagcttcttgatttcctggtctaaaaaactgctttccagcttatatccaaggctcataattacaaagagctattttcaccactgaaattttaaatattaatattctttttttttttggagaggagtttcattctgtggcccaggttggagtggagtgagcaagatcccacattgattcagcgtggagaaagagcaatttcagtctaaaaacaaaaaaggaaaaggaacaattggtttagtgatagatgattcagaatttgcgggtgagaagcagggggggtgttcattatggttggtaggaacgcagaaggggtgcaggggtattgacctgaagggtt

SEQ ID NO: 13446 - DNA, 1360 bp, Homo sapiens
ctgacactacaggcatgggacaaaggcaactaagttgcatctatagaattgagaaaaataatatgctttgaggctgggtacccagcactttgcaaggccaaggcaggaggatcgcttgaaccaggagttcaagaccagcctgggcaacataatgagactctgtctctacaaaaaataaacaaaagctagccgagtgtcatggtgcatgcctgtagacccagctattggggaggctgaggcaggaggagctcaagttgggagctgcaggaagctatgatggtgccactgcattccagcctgggtggcagagtgagactctctcaaacaacaacaaagaaagcattaaaacaaaacaaaaacccacctcattcagggcaataattactattttgatttttcagctcacagacctacattctgcagtcttgtgtatttgagcttacaatggtacccattaaatttggctaaaacacttgggttgctgttttccctaaagaaacactattaagtcacatccccaaaacttacttagtggtcatgacgcatattagtcagtgtactgaaaattaagtattctggcccattaaaatatataaaaaattttaaaggttgtttctgtgcctgtggcatcttttattatctaattaactaaggatcttttaaaaaatctctgaattattttttgaactatcattgccatacaggtttgttttcttcaaccctatcggccctcctgagtctttctgtgctccggatagctcttttcttgtaacatcctcagtccttcaagaactacacactccttttaccctcttctctgaaaggagaccctgctctcttcattccccctcttctagcctgtattgctcacttcacacttctaccctcaggcacagagtcttccctcaggcccaggccacagccttctccattcctgccacggcgccctcctcttctcccaggtctgctggcagcctaggtgacttccacactgatgtccatgacccagacagctaccttcacagcttcttgatttcctggtctaaaaaactgctttccagcttatatccaaggctcataattacaaagagctattttcaccactgaaattttaaatattaatattctttttttttttggagaggagtttcattctgtggcccaggttggagtggagtgagcaagatcccacattgattcagcgtggagaaagagcaatttcagtctaaaaacaaaaaaggaaaaggaacaattggtttagtgatagatgattcagaatttgcgggtgagaagcagggggggtgttcattatggttggtaggaacgcagaaggggtgcaggggtattgacctgaagggtt

SEQ ID NO: 13447 - DNA, 445 bp, Homo sapiens
ctctatttatggactctattctgttcctctggtccgtttgtctccttgtgtcagtacttctctgctttatttactgtggcctaataagtcttgatatccattagtgtgaatattccaactgggcgacagggagagaacctgtctcaaaaaaaaaaaaattggccgggcacggtggctcatgcctgtaatcccagcactttgggaggctgaggcgggcagatcgcgagatcaggagttcgagaccagcgtggccaacatggtgaaaccccgtctctactagaaatacaaaaattacctgggcacggagaaggggtgcctgtaatcccaactactcgggaggctgaggcaggagaattgcctgaacctgggaggcagaggttgcagtgagccgagattgcactccagcctgggtgacagagcaagactccattgcaggaaaaaaaaa

SEQ ID NO: 13448 - DNA, 437 bp, Homo sapiens
gcttataatccaatttcatgacaatcgttggacatgtaattcctttttaaaagtttctcttgtttcttaatgaattacagtttgaaggctcaatttaaagtgtttatcacaaaactgaatttttaaacagcactctccagcatttatgtatttcactttaaaagttaaattatttcggctgggcgcggtggctcacacctgtaatctcagcactttgggaggccgaggtgggcggatcacaaggtcaggagatcgagaccatcctggctaacacggtgaaaccccatctctactataaataccaaaattagccgggcgtggtggcgggcgcctgtagtcccagctactcgggaggctgaggcaggggaatggcgtgaacccgggaggcggagctttcagtgagtggagatcgcgccactgcactacagcctgggcaa

SEQ ID NO: 13449 - DNA, 86 bp, Homo sapiens
cagcttaggcctcagtaagaacagctggagaatgtcaggacaaataacaaactgaacttagatttggaaaacaaaatggaggcttg

SEQ ID NO: 13450 - DNA, 504 bp, Homo sapiens
actgtgagaaagggaccagagaatatctttttctctggcaagattccatctgtggattattttattagacatgccttctgaaagattaggggtggaggatcaaaagaaatattctttatctgaaggctctttgatcttcagggttgatagaatctgttaaagtgttagataatacagtacctaatgatttctttttaggcttaaatagcctcactgaatgagattatttacttaactgtgattgccctttctgtttcggaattgaccttgctaatttttgaatcaggagcactgaaacagatctctaaattttgaaggtctggctctaggaagcacaagtgtggaagattttaggtcttaggttttaatgttcagagcgtttcttccaattcaaaacgtaatcactggaaaataaacttctaaatgaaaatgtgctttggtcagctgcctctgaattatcattgtgcaacattacttaaataaatttgtgtttgaaagaccttg

SEQ ID NO: 13451 - DNA, 771 bp, Homo sapiens
tgtagtaagggttttgagagagcgttccggacttaatctcttcagcagcctcttgcataaatcacattgatactccttttcctgcctccagttgttttcacgtctgtatttttctcctgttatatttacatgttcagtttttatttaacctttgaggaatggaaatgaaggttgtgtctataagtcgaggttccagatataaaattctgtcttcctttttgatcattaacttgtttgtttcagaatatttggtgaatgcaactgtgatgatactagtgtgaataacaacggaagacactcacttggctttggctaggtgtagtgttgactacagaggtgtttaaaaagtggcctgagggccggcctgttagagctcttttggctgtggaagctaatttgtgctgaatgtggtgcctacagaaaaacccttcagaggtcatacagtgtgtactctttctgccggtcagttgaggctccttacctagcttagcaagaggtttctgccctggtcctcaacataaccagagaaagtaaatgggaaactttatctggaaaattattcaaaagcaggaaataaatcaccttggttagcattttaataatttatccatgagactatttacaagttactactttgtcaattcaacaaatatttattgtctatactcttctaggcagtggggtgaacaacacaggccaagttcctgttttcatggaacttatgttctgatgttgggaggcaaataacaaacaacaaacatgtaaaaaaaa

SEQ ID NO: 13452 - DNA, 327 bp, Homo sapiens
ttacgcgtactataacttagtgtagtttagtatttaatgttaattttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtctactgaatgtaaaatataatgcttggtatatgaatgat

SEQ ID NO: 13453 - DNA, 1834 bp, Homo sapiens
cgcccccgcccccaggcttgtgtagatcatgccgccagtagcggccctgactgccgaggaaacggtagcttaggacagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtatattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgattcta

SEQ ID NO: 13454 - DNA, 1913 bp, Homo sapiens
cgcccccgcccccaggcttgtgtagatcatgccgccagtagcggccctgactgccgaggaaacggtagcttaggacagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtatattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgttttttacaatccctattagattgcttctcagttccaacattctgatcccgctgaacatccccacttaattaggctgcggttcactagcatgcgccgccccactccctctttctctatccccaccccccttcttgcatcccaacccacgcttcccaccacgctgcttcccca

SEQ ID NO: 13455 - DNA, 1129 bp, Homo sapiens
cgcccccgcccccaggcttgtgtagatcatgccgccagtagcggccctgactgccgaggaaacggtagcttaggacagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtatattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaactgagataatgtattacaattctatcacaagaaacagcattatgacctatgttttcg

SEQ ID NO: 13456 - DNA, 487 bp, Homo sapiens
atacctgttttagtaaatagtgtttgtgggctttttgccactcctttgaattagtgtattatataaccttacaatagctattttctctttttgattaaagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaagtaagtatgctttctgtctacagaaagtctcctaacactgtcagagacacttactaactaactcattcactcttgtttaccatctagctgcatcaggagatatgcaaacatatcagatccgaactacaccttcagctacttctctgccacaaactgtggtgatgacatctcctgtgactctcacctctcagacaactaagacag

SEQ ID NO: 13457 - DNA, 2446 bp, Homo sapiens
cgcccccgcccccaggcttgtgtagatcatgccgccagtagcggccctgactgccgaggaaacggtagcttaggacagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtatattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgattctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtctactgaatgtaaaatataatgcttggtatatgaatgat

SEQ ID NO: 13458 - DNA, 2342 bp, Homo sapiens
cccttccagtcgtgcgtctcctcctttccctcgcccccaaataaaagtaaagcccgaaaccgcccgccgcggggtggctttcgcctcagaagccgccctttgcagtcgcaggcgctagctctccgtgggaggtctcgagttgattatggaagattcccacaagagtaccacgtcagagacagcacctcaacctggttcagcagttcagggagctcacatttctcatattgctcaacaggtatcatctttatcagaaagtgaggagtcccaggactcatccgacagcataggctcctcacagaaagcccacgggatcctagcacggcgcccatcttacagaaaaattttgaaagacttatcttctgaagatacacggggcagaaaaggagacggagaaaattctggagtttctgctgctgtcacttctatgtctgttccaactcccatctatcagactagcagcggacagtatattgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagttgcagtcctggaaaatcaaaataaaactctaatagaagagttaaaaactttgaaggatctttattccaataaaagtgtttgattcctaagaaagaaaatatttttgtggacatgcataaaaattaaatggatttcctagtggagttttataaattaaaaggtcaaaactgaagctttttatttaggcttttccaaatcaaggataaatatcttacgcacgatatctagtgacagaggagaaagtggaaaatgacctcaaggaagctacgggcacaactggaagctttgtagaaattaaacatattcaaggagcaagaaatgaactttcagcagtctaaattttctaaataaccaatagttgccaatctaaaatggcagagaagatgaaatttgataaactgaattttttttaaaaatccatttaccctacaggtttgcatttgtttgctgaaatttacctttttttagttatatatatgtgtgtgtgtgtgtgtaatttctgccaataaattctaaattacaaaggtaagagaaaacctagtacattactaaatatataaagtatatgttctgattatgtatacttgttctagtgtcaagtctttttaagtgggtttttaaaagtttgttattggacttgaatggatttttgagactaggttaattatttttgaggtcttatcctaaaaggcatctaaggtacatgaatggagtatggtgattttataacattttttatcagaatggaaaaagaactgtttaaaagtttgatacttttaaatagttggtttttttgcttactctggtaatgattttctacaaatacataataaattgtttttttgattctatattctgtatgcagttgaatatccattacttattctgctgtgctttaatagaatggaatgtttacaggcccttaaaatattatttttaaaaaaccttctgaagatacataccaaagtttttccaagaagattttataatcaatttaataatgtaaggtttatcagattctataatagtatagttattaaggcaattttatgttagagactattttgtaatgtagtgagtggtacctttataagaaaagtgactgccaatatatttttatagctgatctttataaattctaatgttgagtttttaatgattattttaaatgtttatatagtttagtaaaatttgcatctcaaagtatcatttttatattatgggacgttttcagattggctaatatttgcattgtaaattttgtatgcagtttatctaaaattcaaaaatactgtcagtacaccagcgtttaacatctatattccaatttgtatacagtttaaaattgtactgcaaaactattgtgtgctcttacacagtatgcatcatattgttgtctgtgaaattaaaggacatttgatagtctactgaatgtaaaatataatgcttggtatatgaatgat

SEQ ID NO: 13459 - DNA, 441 bp, Homo sapiens
ttgtagaaacaggggtcttgtcatgttgcccaggctggtcttgaactcctgggctcaagtgatcctctcaccttagcatccccaaatgttgggattacagatgtgagccactgtgctcggtaccttctttcagttgtgccatatcttgactttgggccaacacccccacacagcctggaaacatttatgatttggtgcttggagatcagagatgtcactaggagcagagcctgcctcagtctagctctggccttggtcctggggaagctgtatcctccaaccttactttgtcttccttccctgatctgatcccactgaccagcaccttatcgacgaggttgcttaaagtaaatcaccatcccgttgagagaggaagtgaatcaaagttagagggaattaacaaatttagtaaacggggaagcatcccaaatccaccaacca

SEQ ID NO: 13460 - DNA, 445 bp, Homo sapiens
cattagaattctattagaaatcaaaacaagatcttcaaatatctggaggaaaaatttcccaaatagtaaaaaaaaaaataaaaataaacttaacccattgatcaaagaagttgtcacaagggatattcgaagctactttgaacagaaataaaatgaaaccgtaacttaatgaaatttgtggggttccactagagttgttcttagaaggaaatatgtagttttaaatgtttatattagaaaagaaaaaatgtctaaagtgaatcatctaggcttccagttataactagaataaaaagaacatgttaaaccctacaagtagatagaaaagaggaaatattaaagatgaaagcaaaagtcagtgacagaaaaaactagagaaaaattaatgaaaccagtagttgtttatgtggtaaataaaattagtaataatacctctaagtagact

SEQ ID NO: 13461 - DNA, 344 bp, Homo sapiens
tgtcctcagaattagtccaggggtatttatccacaatccccattccctcaacttgagtgttgaccctgcggatgttaaatgcacttcctccaggctttcctgagaaatcacttatggtgccagagctgtcatgtagacaagtagagagacaaagaaagttgagctagaaactgtcagattctatagtgagtttccatgatggctgcagggtaattcagagggtgatctagagcatatggggcaaggcatgaaaagcacctctgaaaaatcctgtctccaaatatgtgtaaaaataagttagcacaatatggatgtgaactttcttagtactgttcatggataca

SEQ ID NO: 13462 - DNA, 2047 bp, Homo sapiens
ctgcttcggcctcccagcgtgctgggattataggcgtgagccaccacgcccggcctgtttcctttggtttaaagtggattcgaatcagtgttaaatcagaaaatcagggttttctaggaaattgggaattagttgccagaaaggaaactgaactatgcagaagcaaataagagctgggatgaggctggatggggtgactgacagtccagatcattgaaacagattgggtcgtcggaaactggtccagatgaggctggatggggtgactgacagtctggatcattgaaactgattaggtcgtcagaaacgggtccagacgaggatgaggctgaggctggatggggtgactgacagtctggatcattgaaactgattgggtggttggtcagaaacgggtccagatgaggatgaggctgaggctggatggggtgactgacagtctggatcattgaaactgattgggtggttggtcagaaacgggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaattttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcctttttgttagaaactaataaatgtatcagtcactagca

SEQ ID NO: 13463 - DNA, 1736 bp, Homo sapiens
ctgcttcggcctcccagcgtgctgggattataggcgtgagccaccacgcccggcctgtttcctttggtttaaagtggattcgaatcagtgttaaatcagaaaatcagggttttctaggaaattgggaattagttgccagaaaggaaactgaactatgcagaagcaaagggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaattttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcctttttgttagaaactaataaatgtatcagtcactagca

SEQ ID NO: 13464 - DNA, 2164 bp, Homo sapiens
ctgcttcggcctcccagcgtgctgggattataggcgtgagccaccacgcccggcctgtttcctttggtttaaagtggattcgaatcagtgttaaatcagaaaatcagggttttctaggaaattgggaattagttgccagaaaggaaactgaactatgcagaagcaaataagagctgggatgaggctggatggggtgactgacagtccagatcattgaaacagattgggtcgtcggaaactggtccagatgaggctggatggggtgactgacagtctggatcattgaaactgattaggtcgtcagaaacgggtccagacgaggatgaggctgaggctggatggggtgactgacagtctggatcattgaaactgattgggtggttggtcagaaacgggtccagatgaggatgaggctgaggctggatggggtgactgacagtctggatcattgaaactgattgggtggttggtcagaaacgggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaattttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcctttttgttagaaactaataaatgtatcagtcactagcaggtactggtcctttttcctctcatttttgtggaaaggatatgcaaacactgaatttctcagggagtactaaggctgtgcagaggctgagaatctgaaaaataaaatactaaaaataa

SEQ ID NO: 13465 - DNA, 541 bp, Homo sapiens
  misc_feature (415)..(415): n is a, c, g, or t
atttctaagtagttgagttgttgtgatgagggtacgactgctaatggtcggcaggttttgttttcattggtgaatctggtgtcatcatattccggtcatatgttgaaatattctttgtttaggtctggaagtagaggatctcactctgcacgtccacattgtgttgtttttaaaatgatgtctctgggagtatggatttctagaatttcaaatctgagtgaaggtccgggcatgtgtgggcctcatcacctgggccttgacagtgaactttgtgggctgtgtttcagatttcaaagatttgccccatagctggggaaggagttgtgcatttttgctaatagtcggtgtcagggaatgtaggatgctcgagctggggaaagttagagagggaaggaacatttatatataaataatnggatagttgaatattaggatcagattaatttgggctgatgaaagttttttttttttaaagcagttgtgcactctgggaaggaagtcttttcacaggttcacttgatagggattctttaaggcgagg

SEQ ID NO: 13466 - DNA, 759 bp, Homo sapiens
tgagatggagtctcactctgtctcccaggctggagtgcagtggtgtgatcttggctcactgcaacctctgcctcctgggttcaagcgattctcctgcctacaggaggattataggtgtccaccaccatacctggctaatttttgtatttttagtagagacagggtttcgccatgttggccaggctggtcttgaactcctgacctcaggtgatccaccctccttggcctctcagagtgctgggattacaggcgtgagccactgcgccccagccccttctattgatttttataactccatcctcttgattttcccctcttattttccattggtttgtctttgttcagttgttcaattattccttaaatgttgatgtttcttggccttcttacatcagggctgacaaataggttatacttacacttctgtattactggcagttccctgaaaggactggatttgaaaggattttgagtggtgtcctacccagtgggtaggaatactgggatctgcataggtaggaaggaagggataacagaacatgtgtcacatctttgccatccctgctgtcttcttcttgggtactttaactgagattcatggcttctactatcacttacatgccgaaacatttaaatctctttatttagccaagatcttgccacttggcagttctttatatccatcttccttttacatagctccgcttggcatcccaccagcacctcagactcatgatgaggattgagcttatcactttg

SEQ ID NO: 13467 - DNA, 612 bp, Homo sapiens
  misc_feature (301)..(301): n is a, c, g, or t
gcattttacttccctttaatcaaaaaataaataagtacactccacagggactttttttttttaatgaggaaaaaaggtgaaagaacaaaataaaacaaacaaaaccaaaacctacagggactcttcatttctggcctgcaaggaatcaccagccaggctgagggacacggacagccagcccagctgggccatgccaggtgactcacaaggctgaaaagggagccgctccgctctgggtggttcagtcccagccaggggttgggatgtcctgcctgcggaggggccacagccacatggggcncactcagcagcaggggcacaccgatccctattctgcaaggtgtatcccacaaggcccttcctcttggtggcacctgtgacctctgcagaatttcattttctggtcatcctttcctctcgtggaccccacagcactgcctcaagctcacctggcttttcctgactcactggctcttcctcttctctcctttcatgagtcccttcagattctcttttgttatctacctttgttgaaaggcaacctcagcaactcccatggtcacaacagtcagaacaaacgggtttctatctttagtcctaattctgccttaa

SEQ ID NO: 13468 - DNA, 402 bp, Homo sapiens
cacaccgacgggaaagctggttcctttgccatatcagggcaccactgggtgcagcgtttggcagacctgggtttgaatcctggcttctctgagccttcgtttccgcatctgtgtctgtcattaaaacacttaagaattacctccaaggttttccgcttcaatgtgtcctcagtggagaaaaatagaaccaacctattccgagcagaattccgggtcttgcgggtgcccaaccccagctctaagcggaatgagcagaggatcgagctcttccaggtaactcctctctcagagcagaaaccacaccgacgggaaagctggttcctttgccatatcagggcaccactgggtgcagcgtttggcagacctgggtttgaatcctggcttctctgagccttcgtttcc

SEQ ID NO: 13469 - DNA, 623 bp, Homo sapiens
gtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctcatttataaaaaataaaaaggagagaaaaaataaaataaaatagaagccagttcacagcacgcctgctccggaaagctgttattccattctctctcact

SEQ ID NO: 13470 - DNA, 3425 bp, Homo sapiens
gtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgaaaaaaaa

SEQ ID NO: 13471 - DNA, 1620 bp, Homo sapiens
tgcaacctctgcttcctggattcaggtgatcctcccacctcagcctcccaagtagctgggattacaggcgcctgccaccacagccagctaatttttttgtatttttagtagagatggggtttcaccatgctggccaggctggtctcaaactcctgacctgaagtgatctgcctgcctctgcctcccaagtcctgggactacagctgtgagccactgcacccggcccccaacagttcctcttaaagagcacccgtggccattctagcacttgctcagcttctgggactgcccctggaactgggcgacttcctgggttccaggcctgagacttggccttccaacctctcactgacatgtcccttcccaggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgaaaaaaaa

SEQ ID NO: 13472 - DNA, 2415 bp, Homo sapiens
gtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtatggagcaggctcatgccatctgaggcactggggctgaccgaccagaccacttgttaaaaagaatgagtgaaggattgaatgttgagtgagcaaatgatggtctggggtgagtaaaattcctctggtgaaggttctgatcttggcaccctgactcagttctactcagtcacattctgcccttttaaattcctaccatagtttcaaccagctttttaatttgctttgtccaaagctctctgt

SEQ ID NO: 13473 - DNA, 1871 bp, Homo sapiens
gtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaatatgatcgagggagaggtgagaggagggacccagagggcagacaggagatggttgatg

SEQ ID NO: 13474 - DNA, 415 bp, Homo sapiens
acggtagatctcattaattattttatccatctgattggtgaagaatgtgtctgagcacctctgtatgtttaagggccatgcataattccattttcctgtgtgcacatccccatggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgaaaaaaaa

SEQ ID NO: 13475 - DNA, 453 bp, Homo sapiens
agtttcttttattggtggttttaagttgattttctataaatgttttttgttgtagcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtatggagcaggctcatgccatctgaggcactggggctgaccgaccagaccacttgttaaaaagaatgagtgaaggattgaatgttgagtgagcaaatgatggtctggggtgagtaaaattcctctggtgaaggttctgatcttggcaccctgactcagttctactcagtcacattctgcccttttaaattcctaccatagtttcaaccagctttttaatttgctttgtccaaagctctctgta

SEQ ID NO: 13476 - DNA, 316 bp, Homo sapiens
caaacctcaattttatatttctttatatcttgtttctctcctttattcaatcaacaagcagtttttgaagtgttgtcctgtatcaaggggtcacagatttgctggctatggtctgacaatctaatggagagagagaagtattgtcaaataaagacagtaaaatgtgatttcgcagtctataaatatatacaaataatatttcattcatgagtattcttttaatgtccttcttaaaataacttaatttggggatttgtctttaaaactctcgcaaaaatttgaagccaaattaagttactcatgagataactagttt

SEQ ID NO: 13477 - DNA, 549 bp, Homo sapiens
tcagttaaatgttgggaaaaatgagctcaactcttctttccagcagaaagtagatagtaaggccactttacttattaactgaactcaattaaaaatcatgtcttttttttttaagtaccacagtacagaaagctacgtgtatattacggtactaaaaataaaaattttaaatttagagaaattatttgtttaatgctttttaagttaagcttttaaaagtttcataacaaaaggtgagtaagttcaaggtgggacataagagtacatagaaattaatgactaaaatcaacaaaataatccttgctactaagacaaagttaaaactgagcctgtttgaagtaaaactggtaactcttgagtcacgttaatacactttataaagcaagaatttatttaaaattaaaagtttcaaagaagccaggtgtggtggtgcacacttgtagtcccggcaacttgggaggctaaggtgggagggccatctgagaccaggtgttcaaggccagcctaggaaacggcaagaccctgtctctaaaacaattagtttattaa

SEQ ID NO: 13478 - DNA, 225 bp, Homo sapiens
tccatgggttctgcacctgtgggttcaaccaaccactgactgaaaatatctggaaaaaaattgtctataccaaacatgtacagatacattttcttgtctttatttcctaaacaatacagtataacaactatttacatagtgtttacattgtattagatattataagtaatccagagctgctttaaagtataccagaggatgtgctaggttatatttaaatactat

SEQ ID NO: 13479 - DNA, 345 bp, Homo sapiens
ctcctttggtgctcttcctttctttacatagattttactttctaacctgttatttttttcttctctctagagaacttcttttaacatttcttgcaaagcagatctactggcaacaaaatatctcaatttttgtttgtctgagaaagtctttatttctccttgacttttgaagaataagttcacagggtacagaattctaggttggtaggctttttctctcaaaactttaaaatatttcactccacacttgtttgtatggtttttgagaagtgggaagtaattactatatttgtttctctatagataaggtgtttatttcctctggcttctttctagatatgccga

SEQ ID NO: 13480 - DNA, 299 bp, Homo sapiens
attttgacaagcttttccaagaatagtaaaaatattttacgtataatcttgagaacttaatagctatcttaatcataatcagttcacttcagcaaactgactaacaaaatgtcttacatgttttgcatttgggatacatttgatctaaagactgaaagcatactaattattttgaggagtttctgtaattttgttggctggaaaatgttggcaaactgatcacactgaaagaaagaaccggctgggcgcagtggctcacgcctgtaatcccagcactttgggaggccaaggggggcaga

SEQ ID NO: 13481 - DNA, 488 bp, Homo sapiens
aatctcttttgacagtttaattggcagggcctccagccactgaacctaggagggtacaggaaagaagtttttcctcccctacaattgctgagcttcttgcttaatttagaggctttccatcccaattttattctaacatgagggcgtgagataaatattataaaaatataaaccaaattcatgaaaagctgagagttccaggggtgacagcaatcagtcattctcatttaacaaataccagttgagtgcttacgacttgccaggcactatatcaggcactggggtgcaaagatgaataagcgggaaatgctttctagagacaggaacagagaggagcatgaacagcaataactaactgcctggagaagtccaaaaaagcaaagcttgtcataacaggcataaaaggaaaaggagcaatttcaatcttcctaacctcaagatttccccattaaggcagacaggacctagcaaatgtagtttggggatgg

SEQ ID NO: 13482 - DNA, 874 bp, Homo sapiens
agatcacgttatctgcaaacaagggtactttgacttcctcctttccaacttggatgccctttatttgtttctcttgtctgactgctctatttttgtactcattattagtgccatgttgaataacagtggtgaaaagtaggcatccttgtcatgttccagatcttggaggaaaggctttcagtttttcctagagacaccaaggaatgcagcaagagcaaactttcatctctgtgatcccttgccaagtaattagaaaaatcagtattctaacttttttttttttaaagagataatttagggccgggtgtggtggctcatgcctgtagtcccggcacttttgggaggccgaggcgggcggatcacaaggtcgggagattgagaccatcctggctaacacggtgaggccctgtctctactaaaaatacaaaaaaaagaaaattagccgggcacggtggcgggcacctgtagtcccagctactcaggaggctgaggtgggagaatggcgtgaacccaggaggcggagcttgcagtgagccgagatcgtgccattgcactccagtctgggcaacagagcaagactccgtctcaaaaaaaaaaaaaaaaaaaaagagtaatttagtaatttagtatggtcaaagaaaagaaaggaaatgtgtattacttagactaaatggagagagaaaaagtaagctttcatttttctttcaggtgcagaagggtgtatagaaatgattgaaatgtctgtgtttcaagggctttgagggtgtgcttgtgaatgtcaagttatttgaagacattactgtggcttcgaatcatcatttctttttgataacgaaatgggagggttgtctttggaaattccatttaatattaa

SEQ ID NO: 13483 - DNA, 492 bp, Homo sapiens
cagtgagctatgatcatgccactgcactccagcctgggcgacagagcaagaccttgtgtccaacaacagcaacaacaaatttgaatgaatcaccaccctttgaacaccagaatctgcacggccatcctctttgggaaaccctagggtttccgagccacactgggtccatagtcccatcaagtccactaactggagtgaacactgcaggtgtgcgccttctctgaattaacttaggctggcatcagaataactgcaggagggagaacggccatcttccccatttcacagacagaaaacaaggccagagagatcaagtaacctgccccaagttccttaggaaagtgggaagtgggattcaaacccacgtttaccctggttgcaaccatacccttgggttgtgttgggcagccgctgtgtcctaatgatctggggcccagcctcttcctcatggcgtcacccgcctggccccgggttccctgaaacgcttgaggg

SEQ ID NO: 13484 - DNA, 845 bp, Homo sapiens
tcctctgcactccctagcagcaaaaagcaccatcatctgcccagttgtccagccagatctattactgacacctgcctacctctctttctcccctcttctgtcctttttttccaccttcccagtcagtcagtcattcatatctgtgttctttcttccccctccaaatctacccctgcctgaccacctttgccttcattcaggccctcacctgatcttgcctggagggttctgatgctttctccctggaaggccttgcttaggctggaagatctgatttcaggggggtaggggggtggcccccaatcggcctcccagacttaactctatccctctttgcactccgatccctaggctgacccattcccctttactttttcacggtgccccacttccctgcctttgcatatcctgctttctctgcctacagtgtagaggtcattttcttctgggattctttagagctctgcagggctgacatttacaggggcctgtgctgcttgcgtgtgtgttcagcatttggtgtgcatgacttcttatcacactcagcccctgtgatcctcatttgattggtcacagtaacttcataagctgggcggtattgttattcccagtctacagatgaaaactgaagcagcttagagttgcagcaacttctctgtggtacagctactgagggtagaggtaggcctcgaccccgggcagtctggctccaggctctgtactcttaaccacactggattgcctggctttagtcctcacccctcatcgcccctcctggactgagccccttgaaggcaagagtgttttgagaaacagtgatttgttcgttagtttttatatacaga

SEQ ID NO: 13485 - DNA, 510 bp, Homo sapiens
attcaaaagtatttgtttgcaactcccttatgcaatacgagggtctagctaccaatcaaatatgtgggaaattttttgaacatttcagggaaatgattcctattgtaggctttaacgagctcagaggatgatttttttaaaaaccagtgataaatctttcttgtcttaaggagttctgtttgtaattgaaggaaattgatttaggaaggatgaattgtgcattttagaacaaaaataaggcatgtaagtaaggtgtttatcagtatgaattcctctgagtgctggtaaatgctcttcataacaagttctccagctaaaggctcccattagcagctgttcggtcattaattgtctttcttcaacaagtagtcacaggaaaggtttcatagtgccagagttctttctgtgtgtctcctccatcccaaattcaaagggcatcattaggaacatctgggaggacagtatgacagatagcagaatccttctggtacttgcacttccctgtgtctc

SEQ ID NO: 13486 - DNA, 561 bp, Homo sapiens
tttctctcgtttccttggggcatgacgttagtttaggagcatgagggaggtggggagaaacaccacccttctccccgcccttccttagaattttttaaaaaactttactctgtggagaatcagttccctaggagcctggggcatagtcacactttcattctcatctttgctgctttaccggcttaggtggctgatagttttcctgaattgtttttcaatactcagagctcttgtctttcggaagatggaagaggagcatgcacgatcatagctgctggtgtgtcttccctgtcagcttaaaacgcagatttggccgggtgtggtggctcacgcctgttatcccagcagtttgggaggccgaggtgggtggatcacctgaggtcagaagttcgagaccagcctgacaaacatggtgaaaccctgtctctactaaaaataacaaaaattagctgggcgtggtggcatgtgcctgtaatcccaatgacttgggaggctgaggcaggagaatcgcttgaacccaggaggtagagattgcagtgagccgagatcatgccattacac

SEQ ID NO: 13487 - DNA, 106 bp, Homo sapiens
gaaatcagatgtttggctgaggacatttctatgcaatgtattgaaagtgtggcttggctcctcctgactgcttataataaaatgtgagagagaaatgacttaaata

SEQ ID NO: 13488 - DNA, 999 bp, Homo sapiens
gaaagctctaaggaagcatccatttcctgcctctccagctggaggtagcttctggcattccttggcttgtggttgcatgatgccagtctctgcctctgtggtcacattgcttcctcctcttttgtctgaaaacaccctctgattgcatttagggccaaacttctcaaggcccttaatttaatcactttttctttttggcagtgggagggagcatataaagtaataatcacaggttctggagattaggacatatacgtaattgttttgggggccaccattcagcctactacaaatactttattcttttttattgctccatagatttagaatgttcactctacctatcctacctgtattaagaatatatcatcataatctttctaaaatcccatgtagatctagatagagcagaaaatacaaacttttccctttcccagtaatcaacctacatttaattattcatgctatgatggactgcataaattaaagaaaaaatagaaaatctgaaagggaagataatgatctcattgttatttgtagttgaccatggtcaactataaaagtataaaaatactaaaattattaaatgtcatatttatgatcatttgttcacctgaagagtattgaataataaggggtacatttgggttatactgaatgagtgttgaaaatgattgaaaatcattgaaaataatttatttggggttgaaattttatcaaataaataatctataaggtgtatacattatgagcaagttagcaagagtgtcttgatacaaagtattggtaaaagaaaagatagttcacactgagtttgttttcaatttaattcatttttgcagatgtcaacaaaatctttcacctttttatagtatttaggaagaagagagcatgtaaggtcaaactttaattaacttttctttgcctatactggactttccctacacaagtaggtacttatattctgatcacaagtccccacacgtcggttgtagatag

SEQ ID NO: 13489 - DNA, 380 bp, Homo sapiens
aatcatggaaacttctccactattcctgatacacgttcaatcaactaatacaaagcaaagctcagtgatgcagtagagagagaccaggcctccagagtgatgcagaattatgcagaagaagaatattccttctgcggtcatgactattccaatttactatgaatgtccccatctggagaacaaaacaaacctgattcaaccagaatggataagcagagttagctttcatggtcctataatattaggtgacacagctttggtctttaaaatttgcacaggtgacaaaataaaataaactcaacaatataaccagatggctcattcagttgctggagaatagttttaaatgcatgtaaaatttattaaagtaaaatttctct

SEQ ID NO: 13490 - DNA, 531 bp, Homo sapiens
catagcagattgattttccaaagatggcagcagcaatatctctcatcacgcatatccttataacatgaatttgacctttcttccatgtagagatgggatctatttcccctcttgaatctgggcaggttgtaactgtggcagatgtgattctatatgacttctaaagctttgtcatacaaatgacaaatcatcaccttgccggctagattgctcacggtggatccccgaaccaccatataaacagtgccctgaggttaccatcttgtgaaggagcccaagtgagccaacatgtagagaccacgtggagatgctctgaggccacacgaagagaaagagagacgctcaacaagcccccagctggctagccccccgctctcccagctctggctgttgtctgactctaaccacatgagggacccagagccagattcacttaggtgagtccatcccaatttcccaacccacaggaaaccatggaagataataaaataagtgttgtgtcaaactcccaggcttttgaatggttacaca

SEQ ID NO: 13491 - DNA, 487 bp, Homo sapiens
tcatcaaagagcataaaaaaagactctcaaaataagtttgagtcagcttattacacagaattagggaaaccgccaggtggccaagctaaaaatgcaacagtagaggccatactaacagaatttagatataagttgttgcacactataaaggaaatgaagattacatttgagtccaaggaagtataatttcaactattgatagaattaaaatttaaaacatcctcagatgaatatatcagagtcactacattttattatataaactacccagttttcaaccgaaaattattggacattcaaagaaagaaaaagtcagaaacctgtgacctacactacaaaaaacaattaggtaaacaatagaaactatctatctttagagtttctgggttttggatttaactgaccaaaactttaacgaagttattaaatgcatgttcaaaaactaagaaaaaaacatgctgttttttaaataaacacaaaataccta

SEQ ID NO: 13492 - DNA, 453 bp, Homo sapiens
cttaaatctacctccttccaagattctctactttttcacccacgaacactgactgtagtgtgaaatcacagcccaaatatgttaattcattaaattaggcattcattcccagagtgcaaattcctcaggtcagaatttaggccctccaaggccgggggtggtggctcatgcctgtaatcccagcactttgggaggctgaggggggcagactggttgagcccagaagttcatgaccagcctgagcaacatggcaaaaccctgtctttacaaaaaattaaaaaattagccaggtgtggtggcacgcatctgtaatcccagctactcaggaggctgaagtaagagagtcacttgagcccaggagaatagcttgaaccttggtggggcagaggttgtagtaagccaagatcgtgtcattgtacttcagcccgggcaacaagagtaagactctgtctc

SEQ ID NO: 13493 - DNA, 1771 bp, Homo sapiens
atttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatcta

SEQ ID NO: 13494 - DNA, 1935 bp, Homo sapiens
atttagttatagttttaaaaaagaaattcaagcccattaaaatatgtctggtcaatgaaatgcttccttttattgtgttgtgctattgtactttgtttttcaaaacattgtaaaaatagtatctttggtttagtattttggattatatattataatctgaggagtgttttgcttatgtagaatccagatatatttctgttacctaggagatgttacttacatatgtaatactgtatcctgcacgtggaaatattcagaattgtagatagcataactctccctgctcctattcttttgagcctaggtataattttttttttttttttagaaaaagacatatttagctttaatttctatttatgctaaacatatttataagtagtctgtcaatataataccaactatttttatttttacataattcaattatttcatttgacatgtctggcagactcaagacattaagtaaaaaattggaactatgatttttctttgtcattttttaaaaaagaattattttattaacctgctggcatataatctggagttcttttcacaaccttactttttctgatttgctttattgaatgattgaatactcatttctttctaaaaatatgttgtaaattctcccttggcaagatttctccctatgagggtagttattatttgagtctgccaagtggttaccatggggcaaggtgccatgatgtattcttgggtgcattggttttttgcgcattgtaaatttaagacacttatagtaagtggactcattcatagatgagtttcagaaccttttacgttctcggtagaggcttctgtcggacaggcagaagagtgtattcctcacttttttttttgtcttcaaattccagtaaggcatagcacttttaagaaattagaatttttctatcatctatgcaaatgatatttatgttaatattaaatatcttatgttacactgggagtaatttgaggtgcaattatttttattactactttgaatagaggaccattatccttctttcttcagaaaactaagaagtaagtgtaacttttaaagtaagtatatatcagtgagagtaggcttgttttacaactatttctagccagtgagttgtgttttcatgtctcatcaaaagacaataccacattgcatcattttacaaaatatgttgtcattttcatttcagttgtaacataggaaaatagatatttcctagatgatttctgagtttcttactgcaaagaacagttataaattggtatacatgtgtctctgtaatagggataatattgatatatctgttgctacatatttaagaatcattctatcttatgttgtcttgaggccaagatttaccacgtttgcccagtgtattgaattggtggtagaaggtagttccatgttccatttgtagatctttaagattttatctttgataactttaatagaatgtggctcagttctggtccttcaagcctgtatggtttggattttcagtaggggacagttgatgtggagtcaatctctttggtacacaggaagctttataaaatttcattcacgaatctcttattttgggaagctgttttgcatatgagaagaacactgttgaaataaggaactaaagctttatatattgatcaaggtgattctgaaagttttaatttttaatgttgtaatgttatgttattgttaattgtactttattatgtattcaatagaaaatcatgatttattaataaaagcttaaattctcatctaaaaaaaaaaaaaaaaaaaaaaattttgggggcccggcccggaaagttttacaccatcttgggggcggcccgatagaaatgtccacgttcccagaaccggccaaagtgtgcgtcccccaaaaccgggggcggcttaaaccagggtgggctgtcaagcaacacccg

SEQ ID NO: 13495 - DNA, 3401 bp, Homo sapiens
  misc_feature (1642)..(1642): n is a, c, g, or t
  misc_feature (1649)..(1649): n is a, c, g, or t
  misc_feature (1842)..(1842): n is a, c, g, or t
  misc_feature (2189)..(2189): n is a, c, g, or t
  misc_feature (2249)..(2249): n is a, c, g, or t
  misc_feature (2290)..(2290): n is a, c, g, or t
  misc_feature (2332)..(2332): n is a, c, g, or t
  misc_feature (2343)..(2345): n is a, c, g, or t
  misc_feature (2352)..(2352): n is a, c, g, or t
  misc_feature (2385)..(2385): n is a, c, g, or t
  misc_feature (3394)..(3398): n is a, c, g, or t
  misc_feature (3401)..(3401): n is a, c, g, or t
atagcctttagcctcatggggttgttgagcagttgaaataatagctagtgtgaggaactgaacataaaattttagttttaggatgggtgtggtggctcacgcctataatctcagcactttgggaggccaatgaaggcggatcacttgagcccaggagttcaagaccagcttgaccaagatggcaaaaccctgtctctattaaaaatacaaaaaaattagctgggcatggtggcacacacctgtaatcccagctactagggaggctgaggcaggagaatcgtacttcccctttatactcttctgtatatttgattttttttttttttaagacagagtcctggctctgtcgcccaggctggagtgcagcgacatagtctcagctcactgcagcatccgtggaggctgaaacaggagaatcgcatgaattttttaaaaaatctaaacatgtaattttaaaacgggcttaagaagaatgataacagttttggtcttcttttttatcaaccatgcttttattttacttgaatctcgtgccaattgctttgtaatattaaagtaggatttacacaagtggaatttagaaaagatgataatctatcaaatctgtcaataccaattagaatgtaataaagaaattaggatagtggaggtttgagcaagtaaaggctcacccaaattcaaagccaatacttgatgctgagaggggatattttctggaaggtaatttttaaaaattaaagtcacaattataaattgtatatttcctaataaaagaaatctcaactcatgggacaatttgaatttaaaacactattgttcctcattcagtgatgaacaagtcaaaacgtttcagaaaagaaagcctttaaagaagaatcctggcacagaaaaggtccatttagacattgccttcttcccccatctctaatgcctcttttcaaatctctgacttgcacatgaagtaacagtgaggtgtcctgtgcagcagtcgcaattttttgacttgtcaaattgaagaaattcaattatgtagccagagcttagatcactgacatgtatactggcataagcttttttttgtttgtttttaattttattagaagtgggatctcattttgttgcccatgctggtctcaaacacctgtcttcaagtgatcctcctgcctcagcagcatcagtttaatatctagataaaatctgatgtatgtaattttacttttaagggtttttttccaaacagacgtcctgacaatgttgtttcctattccttgaacattcacctgacgcttatatactgtcattacttttatctgtcaactgatgtcagctactcaatttacacattacttttgtgcatttcatcctgtttctcagtttgacattgtcattcaaattcagagtttgacactgaaaccctgggcatggtggctcacacctgtaatcccagcacttcgggagactgcggtaagcagatcatttgaacccaggagtttgagactagccttggcaacatggtgaaaccccatctctaccaaaaaaaaaaaaaaaaaaaagcaaaaacaaaaattaactgggcatagttgcacacacctgtagtcccagctactcaggaggctgaagtgggacgatcgcttgagcccanaaggcanaggttacggtgagtagagattgtgccactgcactccagcctggacgacagggcaagacgctgtctcaaaaataaaatattagtaaagaagagtacaatcagaatatgaaaatgtgtaaatgtgcatattctctttttttctaatttggtagcattaaaaatacttaagcatcaaagtttggctttatgaaganggagtctgagacacctcaggtttcagcccttactaatagcgtggctcaaagagcgttaacttgcctgtgcttctgtttccttatctgtaaaatggggatgatgctgtaacatcaaagagcttataatactttccagagctggcagtactaaataagaccattcctctaaagtgccagcattttgaaaagcatcaacccatcaaccttgtgctttaaatctggcattcttaaagctatacctgtaggcagtatagagtgtttttttttatttgtttttttgttgttgtcttttgagtctcactctgtctcccaggctgtagtgcagtggcacgtcttggttcgccgcnacctccgcctcccaggttcaagcgattctcgtgcctcagccccccgcatagctggcattncaggcacacaccaccacgcccagctaatttttgtagttttngtagtatctactaaaataaacagggtttcaccatgttggccnggctggtctcnnnctcctgncctcaagtgatctgcctgcctcggcctcccaangtgctgggattgcaggcgtgagtcaccatgcccggccggcagtgtatatcttctaaagttgcaatttttgttcactccagaatcacttttcaaaaagcatgcagatttaatgccaccagtttgtgttatgtatctatcccgcaaaacagctctaaaggtgatttactaaaagattaacagcatttatctctggtgggataatttttctttgcttgtttacctgtgtcttgcagattttacacagtgaacaatgactgtataattttaaaatacagatatgcacaattgtgtaatgtaaatatgctcagcttcaatacatttaagaacacatttttaacttttcgtaaggagtcttcagtttaaaagtacagtgtcattacagagtgcttattctgttacaaaattagtaaagctgattctgcctctaaatctgaagtaattcccactttttttcatgcttgagtttagttgataaatagcattttagatactaaaaatgattggatgagtatttctacattaataagttgctaattaggcaccagggtagcagatagaatgcctttctgtgtgctaggtttaaacattttacacacagtcttatttaaaacagccttgcagtttatagatgaactgattgttaggctaaccagaggtgttactataccctccaggataacccagctagtaagggcagagccaggatgattcagacccagaccagagccgggtgttttgtccacagtactgctgctgcttataccgtaacgggaaaagtacacaacagtgtcttaatatttcattcttccatgaaaaacacttttaaaatattgaaacattataggagcagaagtacatctctaaatatacttttaggtcacattgaaaacatttccaaaggatttgacctgaagttaatgttgctacattatgctcaatacagcaggctgttctgctagggaaattgttaatattttaaaaatattttcctaagctttagctttaccannnnnaan

SEQ ID NO: 13496 - DNA, 1851 bp, Homo sapiens
agtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcgtaaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaatttcataaatgtgcattgatttttgtacacatggcacctctttttcatttttatttttatttttatttttttggacgatgttttgctctgttgccgccactgcactctggcctgggcaacagagcaagactcggtctcaaaaaaaagaaaaagagggttacagatcattgcacatggaaaatattcccagcagtaaccacttccattaatgtgatctacagcttttaaaaaggagcatctcagaataagatggtggtacaatttgcttattgagaaagga

SEQ ID NO: 13497 - DNA, 2038 bp, Homo sapiens
agtgacccagacaaagagaggaaagccccggagaatcatgctgacaccatcgggagcggcagagccatccccattaaacagggcatgctcttaaagcgaagtggaaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcagcctgtgcacccatctccagctctaaaagcaatggcctatccaaggacatggacaccgggctgggtgactccatatgcttcagccccggtatctccagcaccaccagccccaagctcaacccgcccccctctcctcatgccaataaaaagaaacacctaaagaagaaaagcaccaacaactttatgattgtgtctgccactggccaaacgtggcactttgaagccacgacgtatgaggagcgggatgcctgggtccaagccatccagagccagatcctggccagcctgcagtcatgcaagagcagtaaaagcaagtcccagctgaccagccagagtgaggccatggccctgcagtcgatccaaaacatgcgtgggaacgcccactgtgtggactgtgagacccagaatcctaagtgggccagtttgaacttgggagtcctcatgtgtattgaatgctcaggtatccaccgcagttttggcacccgcctttcccgtgtgcgatctctggagctggatgactggccagttgagctcaggaaggttatgtcatctattggcaatgagctagccaacagcatctgggaagggagcagccaggggcagacaaaaccctcaataaagtccacgagggaagagaaggaatggtggatccgttccaaatatgaggagaagctctttctggccccactaccctgcactgagctgtccctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcgtaaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaatttcataaatgtgcattgatttttgtacacatggcacctctttttcatttttatttttatttttatttttttggacgatgttttgctctgttgccgcggagcttgcaatgagctgagattgcaccactgcactccagcctgggcgaccaagcgagactccatctcaaaaaaaaaaattagctgggcgtggtggcgggcacctgtagtcccagctacttgggaggctgaggcaggataatggcatgaactcaggaggcaaagcttgcagtgagcagagattgtgccactgcactctggcctgggcaacagagcaagactcggtctcaaaaaaaagaaaaagagggttacagatcattgcacatggaaaatattcccagcagtaaccacttccattaatgtgatctacagcttttaaaaaggagcatctcagaataagatggtggtacaatttgcttattgagaaagga

SEQ ID NO: 13498 - DNA, 491 bp, Homo sapiens
ctgaaagtgttattttgagtgcttttagtatgtaatataaactgtataatttttaaaaagactttatataaagccctgtgttgctctcaatctgttttcctgccactgacaaccttcataaacttgtccacagaggatgccatagccccagggggcaggtggagaaatcatggtcaaattaaaaacaacgttcccattgcgtaataatgcagggtcctaaaacaagtaacggcgtccttattagaaaatctgtatttttttcatcatggattagttttaatcttttacaaatattgcacttaaacactgtttatcttgattactgccatttttgctgcccacttaaattttgtccctgaaagaatgcctcatccacctcactctaacccaggccctgttacacacccttctgaggatggttttatttattttatgatgtgaatctaagactattcgttttatttttctgtactgcatttttattttgtaaa

SEQ ID NO: 13499 - DNA, 691 bp, Homo sapiens
cgtgcccagcctatcatgactcaactgggatctggcacactgcactgggtgttttgttctctgatgtgcacattgatgaatgcatattggtacaagggaaatgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttt

SEQ ID NO: 13500 - DNA, 500 bp, Homo sapiens
caccaggatatctgaaaatccctaagctagttgcagcttccacttagcttttaaaatcactcactgttaagtaaatgaaaaactatactggggtctaaacagtaccatgtaacctaaataatgtgttttaaaatgggatctggttgtaggcatgtttgacttcacactgtaaagtaagtgcaggcaagggtatgcaattatctttacagtaagtcgtcagcaattgttattaactaatgatcaaatatttacttttgtctggcttagatttcaatcacagtaattagaagaaaagaacatccactacttactgtggtatattgttttaataagagaccgcaagtggagggcctcataccaacaggaatttaaatcacatctttatgatggaagttaatctctctaatatgctttttcaaggttttgtgattttagcaatggatttccctcagcagctaccaagcagtattttaagagatgcttaaagcaaaacacatgca

SEQ ID NO: 13501 - DNA, 303 bp, Homo sapiens
atggttctccttgctttaagccttgataggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaaac

SEQ ID NO: 13502 - DNA, 1890 bp, Homo sapiens
cttgacagtgacgggaggcaagggtgagagagaacactgggctgctagggacaggcagagaagatcaataaccttgcaccaattgggatccaaatggctgagtagacagagaagggagaaagacttgaagaatatgaaaagtatctggcctagtcttacccctgcatccctggggaaggatgtgggccacagaggtatctccatgtttctgttatgaaaggagcccacaactccagatggctagaaactagcccaagtcatatgtgcatccaaacttctgtgtcttggggcctgctggagactttttgacctactaccacgacgactaacaacactgctagcaaattccccggatggtcactgtcaattcctgctgctgccctttatttcctccgcttaaggcactgaggaacagaaattgaagatgcatcccatacaggttaattttctgtttttttttttgttgttgttgttgttttgttttgttttgtttttctcttgagacggaatctcgctgtcactggggatggagtgcagtggtgtgatcgctgctcactgcaacgtctgcctctcaagttcaatgattcttctgcctcagcctctacttggggggcagaggtgggaggattgcctgagcccaggaagtcaaggctgcagtgacctgaagtcacgccgccacgctccagcacaggcaagagtgagcccgtctccaaaaaaaaaagggggaaaggttgtaggtgaataagacattacctacacagggcaagaaacagggtgaagccagcaaaactactgtgaatgcatttgtgtagtttttgctcttggactggtgtttattttacagaactacaaaacaaaagcaaaaagcaagtccctaaacactaagaaaaaatgaatccaactgtgtatcaagttgacagcataatcagagaaaaaattattttaattttaaaactattttcattgcgggtctctagtgggatatattctaagaataaaaataattgcaggccaggcgcggtggctcacacctgtaatcccagcactttgggaggccaaggtgggcagatcacgaggtcaggagttcaagaccagcctggccaacatggtgaaacccccatctctactaaaaatacaaaaattagccgagtgtggtggcgggcacctgtggtcccagctactcaggaggctgaggcaagagactcgcttgaatcccggaggcagaggctgcagtgagccaagattgcaccattgcactccagcctgggtgagacagagccagactgtgtctcaaaaataaaataaacataaagggatgattcatgtcccacccaggacagagcagaacagtgagagattttatcatgttactcagaatggggtacaatttaaaaacttcaaagggtttatttctgttattttcatttaatgtttccaaaccacagttgatcaagagtaactgaaacaaggaaagcaaaaccacaggtaggggggtttctgtactgttccattttgcctaagtcttgaaatccccacaagaaaagttttttttgtaaagtagttgaaagaaagaattgttgactaaaatgatattaaatcccctcaaatgaactgaaggcctacacatgaaaaatgttataaaacttaaatcagtggagacgcaatcatcccatgctggaagaaatgtcaaaataccaatgggtaattatctttttcctgatttttaaaaatatacataatttttaacccagaaattgtaatgctaagagtttcttagaataaaccaaacattgtgcaagatgttatattcagtaatactggattaaataaatgttatagccatatagtggaatactgtgccattaaaatgatatatttattgatgtgaaa

SEQ ID NO: 13503 - DNA, 1338 bp, Homo sapiens
cttgacagtgacgggaggcaagggtgagagagaacactgggctgctagggacaggcagagaagatcaataaccttgcaccaattgggatccaaatggctgagtagacagagaagggagaaagacttgaagaatatgaaaagtatctggcctagtcttacccctgcatccctggggaaggatgtgggccacagaggtatctccatgtttctgttatgaaaggagcccacaactccagatggctagaaactagcccaagtcatatgtgcatccaaacttctgtgtcttggggcctgctggagactttttgacctactaccacgacgactaacaacactgctagcaaattccccggatggtcactgtcaattcctgctgctgccctttatttcctccgcttaaggcactgaggaacagaaattgaagatgcatcccatacaggttaattttctgtttttttttttgttgttgttgttgttttgttttgttttgtttttctcttgagacggaatctcgctgtcactggggatggagtgcagtggtgtgatcgctgctcactgcaacgtctgcctctcaagttcaatgattcttctgcctcagcctcgtggcgggcacctgtggtcccagctactcaggaggctgaggcaagagactcgcttgaatcccggaggcagaggctgcagtgagccaagattgcaccattgcactccagcctgggtgagacagagccagactgtgtctcaaaaataaaataaacataaagggatgattcatgtcccacccaggacagagcagaacagtgagagattttatcatgttactcagaatggggtacaatttaaaaacttcaaagggtttatttctgttattttcatttaatgtttccaaaccacagttgatcaagagtaactgaaacaaggaaagcaaaaccacaggtaggggggtttctgtactgttccattttgcctaagtcttgaaatccccacaagaaaagttttttttgtaaagtagttgaaagaaagaattgttgactaaaatgatattaaatcccctcaaatgaactgaaggcctacacatgaaaaatgttataaaacttaaatcagtggagacgcaatcatcccatgctggaagaaatgtcaaaataccaatgggtaattatctttttcctgatttttaaaaatatacataatttttaacccagaaattgtaatgctaagagtttcttagaataaaccaaacattgtgcaagatgttatattcagtaatactggattaaataaatgttatagccatatagtggaatactgtgccattaaaatgatatatttattgatgtgaaa

SEQ ID NO: 13504 - DNA, 866 bp, Homo sapiens
cttgacagtgacgggaggcaagggtgagagagaacactgggctgctagggacaggcagagaagatcaataaccttgcaccaattgggatccaaatggctgagtagacagagaagggagaaagacttgaagaatatgaaaagtatctggcctagtcttacccctgcatccctggggaaggatgtgggccacagaggtatctccatgtttctgttatgaaaggagcccacaactccagatggctagaaactagcccaagtcatatgtgcatccaaacttctgtgtcttggggcctgctggagactttttgacctactaccacgacgactaacaacactgctagcaaattccccggatggtcactgtcaattcctgctgctgccctttatttcctccgcttaaggcactgaggaacagaaattgaagatgcatcccatacaggttaattttctgtttttttttttgttgttgttgttgttttgttttgttttgtttttctcttgagacggaatctcgctgtcactggggatggagtgcagtggtgtgatcgctgctcactgcaacgtctgcctctcaagttcaatgattcttctgcctcagcctcccgagtagctgggattacaggtgcccgccaccacacccgggtaatttttgtattattagtagagacggagtttcaccatgttggccaggctggtctcgaattcctgacctcaagtgatctgcctgccttgacctcccaaagtgctgggattacaggcgtgagccaccgtgcccggcccattcttctaatctaactcatatcagccacataaagtcattgtctctagaaaccctaattgagtgttcttaacagctcttgctctct

SEQ ID NO: 13505 - DNA, 434 bp, Homo sapiens
tacatatttttaggatacattatttactcttttataagcaggctaagtgctgtaaaggatagatatttctttacctttccttgtgacaatgttgaagctttaacctgtttacagcataaagactctgttaagtacaatcttaatctttattttttagtattctcaaatctactacatatgaatctaatttttgcagtgaaataaactttctctcttcgttatttagctgtttcaaaatccctaacttttgtcttcctgtctactccttcctttctccttcacatttccaagcagtatttggaaacatgacaatatatttttcaagtatgtttatgttcttttatcaatgaaaagcttccctaagatagcaatgtccctaatagggtaaaatacagttagctgtatttttttaacctcctcatagcaataggatg

SEQ ID NO: 13506 - DNA, 229 bp, Homo sapiens
ggtggagaagatactgcaggtaataagacagatgagatccctaattctacggtgcagatgttttagaggaggtgacagacaggaagccattatcctaatagagtcggtaatttcaaaaagtgttgtcttcagaaggaaaaaatttaaaaggcagtatgatagaagtgactgtgatacaaaggtggacttttttaggttagatggtcatggtgtgtgtgtgtgtgtgtgt

SEQ ID NO: 13507 - DNA, 214 bp, Homo sapiens
atgaaaagtgctacttcagtgaatacacgaatgataagagagtgaaacagccttattgctgatatggagaaagttttagtggtctaagatcaaaccagccataacattttcttagtccaaaatataatcaagagcaaaggcataggtctcttcaagttaatgagggctaagagagatgaggaatctcagaaggcaagttagatgctagcaaggg

SEQ ID NO: 13508 - DNA, 478 bp, Homo sapiens
tttgctctaaaaaattatgacagtgttttagtaggtaaatttcctaatgtgtatacaattgagttagacaatttttatttgcatacatttttcttaattgcatctttgttttaaaaaaaaaacaaggaacgtatgtgcaaagaaatgctttaagcagccacttaggctgactgtcagtttccctttgcagattaccttgatgtgtgaggaagctgatttggtattggaaagtattgtggagctaggaggaatcaaactgctctattttcttcattttcaaactcaccttgggcaggcacgtaaacaccattgtccaggctttcattccagagggagatgtctactttgctgtttttctttgtgtgaagacaatgacagtggttgaaattacaggatagaatatgagaatgctaagtaatactgtgaaatcccagaatctactttattcaggaagatgaataaacagagatgtaaaacc

SEQ ID NO: 13509 - DNA, 365 bp, Homo sapiens
ctcctgtcaaagtccctgccccgctggatcggacacaggcttaaattaccgcatcgtttgcacccctctgttctaggattaccttgatgtgtgaggaagctgatttggtattggaaagtattgtggagctaggaggaatcaaactgctctattttcttcattttcaaactcaccttgggcaggcacgtaaacaccattgtccaggctttcattccagagggagatgtctactttgctgtttttctttgtgtgaagacaatgacagtggttgaaattacaggatagaatatgagaatgctaagtaatactgtgaaatcccagaatctactttattcaggaagatgaataaacagagatgtaaaacc

SEQ ID NO: 13510 - DNA, 381 bp, Homo sapiens
gccaaattacagccaaaaggttgtttttgaaacttgaatctagagcaagaggaattaattagtggattctaaatttcaaataatttgatagcttcagagcatcaaggtgtacacataggttcttttttcctggacagtaagtgtccactgatgattgtcctcccttcttaggtacatctctttttctatctctgatatgctaatattttcagtcagattataatctggtttggggatccttgtgactgtttcaagtgtctacatttattctctaaatcagtttatcttaattgtaaagtttaaattctaagtggcaagcttattttctttaagaaaaaataatgatggggtagggaggtggggctggggtaccatattaca

SEQ ID NO: 13511 - DNA, 2779 bp, Homo sapiens
tcagggatctgacctggcagctattcctccttctctgaagagttcccatcagtagtcattacaactacctctcgcctcaaggctccatttttagctgctgctctgatttcagggcagccagtactctggccccttcagtcggggagtggaaggagatgtggggtgggggtgagaaaatgcttctgcctgttgttcttgaaggatagactatgggtgggcagagagaactgggggcagaaatggaattagatgtgattgggttatgcagtcaactagaggtctccttcccgccctctctccacacagagaggaacctctgctccttagctcttacagcaggactgtggcatctagtcacttcaatactagttcttgctcttcacagaggtagatttttctttaccctacagcactgttgggcatccctcccatcacatgggtctgtgggtgagatatgttatgctgttcctccctcgggaaggttggtattgaggggtgccttgctccagaggcgccagcccagcatctgtggtgagttggctaagatccagagtgacctgctcagagctccccagaggccttcactctttggggcagtctctctagggtcactttctgaatgtaccttctacctaaagtatacaaacacaaagagccagctgagctggttctagtgtgaaagccgtaagtgccacccagcaggcgtttgaaaacaagaaatcattcttctgtggaaggagaatgtgccatctcagctaccctcagtccgccaggcagcccagtctgtgtattcatatgaagttgtgaaaaccatgagtgtgtgccatggccatcgtgtctacacacagccactattgttcctgtgggctagtctccagcaaattaaaacactggcatggcctaggaagggcgttgcgagctcctaaatggaaagcttctctgggggtagggagatgaagagccaagatgctggtgaagcaggtgcagtgaggatccaaggcaaggaattgccctgagggaggtggctgcatatggagaaaggcagttctctgtgggcaaggccagcttgcttcaggctgtagagggaatttggtctgaagcaacagggcatgaactgtgactttgagctgccaggttgtcttcatctcagaactttcctatcctggcactctcgttacctttcttctataccttggcctctgtaactgcagtccaaaacaagttacagctgccttaatccactgagattctctatgaggatgtacagaaaagttttcctgtaataattttgcttatatgctaactcttttcatgttagcaaagaatattctatgaattagaatgttactgtggtagatctaaaggagaatgaacagaaggtgctggaggacctgttaaacaatctctggctattaaaaaacatcaagatgagaattaaaggcatatcctgatatacttgcctgcttgcacatgaggctgggagatcccatgcctgttgaagttaactctagccctgacctctattgatcttttgggaatgagggctgatttgaaggtgctgttgcaggatttcatttagctgctgccagttcaagtgacctgtccccagggctgcagctgtatccacctgattgcagtaggtgagggctaacagcagaatttaaagtggaccctgggctgtggagcaaagtgactatccatttggacttttggataatgtggcaggagtcccagctgtttaatttctagtcacattttccagaaagttgttctaagttgagattactgacaagatttctcaagggcaggaccagatatgtgagagacttctagttcagagctgacccctctaagcctctgacacttaaacacgagtcctgctgtccccagcacacaactgcactgaagccttgttcctctcggctggtgtagagctcatctgcatgttgtgtgcagataccagtagcctccctgcttgaacaggcctctcctaggctaggcaggtgttcagaggcatgaaggtctgggcaggggaagggcgtcttctgaaatgggagttaccaggtttttaaatgctgctattgttttatttaccatttaaggtcttttctattatatctgagtaactagtcagtttttcttacagtgctcatagcagttgtatttgaattgtattttcagtgaaatttgttttacattgccatttaaaattggcctttaacagcttcccaactggcttataagatttttttttttaatgaaaacataacccatgaggctcagatgctgttgaagaaataaatggtatgttgctgctgacagtagtgcttgcctattgtaacagcattggttctgctgtagcctcggtgaccatttaagttgaataaatctgtcattttcacccacaaacagttgttgagcccctggatttgggttgtcactgtggttctcctgccagtgctataatccagtgtcgtaggtgcagggtatgaatcagctcagcctcttaggagagaggggctctcagcgaggagggggcggggggggggtcactatttatcttccagaggcagggttcatggattcctgatgtttagaggcggaagggaccttaggtcacctacttccacggttttcatactgttctctggggcctcgtggagagggagcctccaggcccattcaaagctttattagatttaaaagtaagatctggtatgaagaaaggttttgtttgtttcttaaaataaaaagtctgaaaatcactaatccaatctcc

SEQ ID NO: 13512 - DNA, 287 bp, Homo sapiens
tgtcattctcaccttgtagacgagatgacccaagctcagagaagctgtctggctggaacgaggttcctgcagctcgaaaaccaagagtcgagataagcgtcaaacatagcctctcggcgggcgcagtggctcacacctgtaatcccagcactttgggaggctgaggcaggtggatcacctgagatgggtggctcgcttgagcccaggagtttgagaccagcctgggcaacataatgtgaccccatctgtacaaaaaattaaaaacacatgcacacacacaaacacaa

SEQ ID NO: 13513 - DNA, 323 bp, Homo sapiens
gagatggagtctcactctgttgccaggctggagtgctgtggcatcatctcgaaagctacttgaggctggtgtggtggctcacacttgtaatcccagcactttgggaggctgaggcaggagagctgcttgagcctaggagtttgaaccgagcccgggcaatgtggtaagaccctgtctctcattaaaacaaacaaacaaaacacacacacaccaagactacttgatttctcccacttgattttgagattcctcaaaaggagataatcttccaacagcatgttttatactacgtacaatctcaactccactttataaatgaaaca

SEQ ID NO: 13514 - DNA, 448 bp, Homo sapiens
ttttttagtatagaggggtttcaccatcttggccaggctggtctcgaactgctgacctcaagtgatctgccccgcttggcctcccatagtgctgggattaaggtgtgagtcaccacgcccggcctcaatgagatattttatactcctttttcataataggtctgaaattggtgtgtattttacatttacaacacatagcagtttggaatatccacgtttcaggtgcttgtatggctaaatggatactgtattggacagtgcctgtctgtatctgtaaatgtcatagacagctgatgatttgggaaaagcctagcttgtaatgatgaggctgggttttgttactagcttccttcatcagttgggaaaatcctgtaacatttgaatttggggattatctgtcctatctcatgggttaagaagctccggttgaataaatcactttacctta

SEQ ID NO: 13515 - DNA, 410 bp, Homo sapiens
tatgtggaaatgggaaatcctaataaattgcaaaagggcttgatgtttgggaagcttaactaatatgctggtttgctagtgtttaagatatacaaataggggccgggcgcgggggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaaaaaaaagatatac

SEQ ID NO: 13516 - DNA, 6019 bp, Homo sapiens
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13517 - DNA, 535 bp, Homo sapiens
ctatcacatatattaaaatttaatacaatccccattaagaaattgtgcccatccaggccaaaaattcggcaccaagacccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13518 - DNA, 4497 bp, Homo sapiens
  misc_feature (1)..(1): n is a, c, g, or t
  misc_feature (54)..(54): n is a, c, g, or t
  misc_feature (66)..(66): n is a, c, g, or t
ngatcagagagagagagagagtgagagagacagactcaagcggtatgtcctcanggatgccagaancagatgatctgagcagagatcagaggagcagagagcagccaaacacacctcatctcccatgctgctgtccacaatacctctacagttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13519 - DNA, 4591 bp, Homo sapiens
ttcttttggaggattaggactgcaaggcaagaggtggaaaagcaaatgaaataactcatgctgaatctgagctgcttaactttactgtccttttcaagcctttctctgaggtgaggtatttggccattttattctgtcttcctgtataaggttcagaaatgaaccaggtctggataggatgcacaggctgtaatctgggctgcccactgaccttgtctttcacttccgtgtgcctctactcaaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13520 - DNA, 5077 bp, Homo sapiens
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgtgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13521 - DNA, 2915 bp, Homo sapiens
ggctcagaaagtccagaccctgtagccagaactaagatacaaaacaagatcttgctccaaaggctgtatccttagccacatgttatattcacctggggagctttaaaaacacatacacagtgtgcaggtcccaccacagatgagtttatcagttcctggcatcagctctacttcctagccatcgccccctaattctccaacgcaaggcgaggctcagagccctccagggtggctcagctggccccagagggcagcaggtgggcctttcttagcctatggacccttacaactctccaaacagagtaagggcccagagaaggacctagctgcaaaattgattccatgccattcccccacccgactcctgcatatcctgcttgctgtcctcacctgctaggttcttggtggcctcctgcatggagtcccccaatttgcttccctctgccctgtaccctctccctggctttgctggtcctggccaagtggggccacaggagcccgagccccctgtgagacccactactgcccagcctcttactgtgcttgcatttcaggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13522 - DNA, 3128 bp, Homo sapiens
caagcaaaggtaaataatgagagcagtttattgtaagaaggggcccactgggacagcgtataggaagtaagatggctctgtctctggagaaggctgcttcctcagtaagttcctagtctttgctcccagagctattagctgtctgctctggaagcaggggctgtgtaggaggcagtgggctgtggaggcccaagccttgtttggttttagtaccaatgtggttttagccagctacattctgcttctgtgcttggtgttttcctcttgtcagctaacacctgttagcagacttctcagcatcagcaagagattgaaatgagatgatgtgtgaataattaggagctttggaaactttgaaagtgctccctagacctggattttgattgttgtgttgatgctgccaggcattttgctgagcacctgccgtctctgagccaggcaaggtggggctggatgccagaaggcagcaggtgggcctttcttagcctatggacccttacaactctccaaacagagtaagggcccagagaaggacctagctgcaaaattgattccatgccattcccccacccgactcctgcatatcctgcttgctgtcctcacctgctaggttcttggtggcctcctgcatggagtcccccaatttgcttccctctgccctgtaccctctccctggctttgctggtcctggccaagtggggccacaggagcccgagccccctgtgagacccactactgcccagcctcttactgtgcttgcatttcaggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13523 - DNA, 3278 bp, Homo sapiens
gatgctctctctgtgggggtagctggcatgcctgggaagctgggaagggggaggcagaggaagaggaggaagaactggaagagtgagtgctgtgcagagtactactagaggatgaataaggaaacctcatggggggcgctggagcagaagaggaagcaggaggcagagagtggggtgaaggagccagagttgggcccttctctgggccaggaggaagtaagatggctctgtctctggagaaggctgcttcctcagtaagttcctagtctttgctcccagagctattagctgtctgctctggaagcaggggctgtgtaggaggcagtgggctgtggaggcccaagccttgtttggttttagtaccaatgtggttttagccagctacattctgcttctgtgcttggtgttttcctcttgtcagctaacacctgttagcagacttctcagcatcagcaagagattgaaatgagatgatgtgtgaataattaggagctttggaaactttgaaagtgctccctagacctggattttgattgttgtgttgatgctgccaggcattttgctgagcacctgccgtctctgagccaggcaaggtggggctggatgccagaaggcagcaggtgggcctttcttagcctatggacccttacaactctccaaacagagtaagggcccagagaaggacctagctgcaaaattgattccatgccattcccccacccgactcctgcatatcctgcttgctgtcctcacctgctaggttcttggtggcctcctgcatggagtcccccaatttgcttccctctgccctgtaccctctccctggctttgctggtcctggccaagtggggccacaggagcccgagccccctgtgagacccactactgcccagcctcttactgtgcttgcatttcaggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggca

SEQ ID NO: 13524 - DNA, 6076 bp, Homo sapiens
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcaaaaaaaaaaaataataacacaaaccaacccacaacatcagcacaataaaaaaagggg

SEQ ID NO: 13525 - DNA, 6359 bp, Homo sapiens
attccccctcctcccccgggagcggcggcggcggccgggccggggccccagcgcgggccgggagggggcacggcggaggccacggaggcaggcgcgggagaagaccgcgctccgcttcccgggccgcgccgacctgctcggcggcctgcccgcccgcgcccaggggccccgaacggtggggccgggcaggcggctgaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgagggccagtggctatgccgctgctgcctgcagtctccctcccggcctgtggattgcatcctttgccccaataagggtggcgccttcaaacagaccagtgatgggcactgggcccatgtggtgtgtgccatctggatccctgaagtctgctttgctaacaccgtgttcttggaacctattgagggcattgacaatatcccgcctgcccgctggaaactaacctgctatatctgcaagcagaaagggctaggtgcagccatccagtgccataaggtgaactgctacacagcattccatgtgacatgtgcacagcgggctgggctcttcatgaagattgagcccatgcgcgaaaccagcctcaatggcaccatctttacagtgcgcaagactgcctactgtgaggcccactcgccaccaggtgcggccactgctaggaggaagggcgactcccctagaagcatcagtgagactggcgatgaggaagggctgaaggagggtgatggagaggaggaagaagaggaagaggtggaggaagaagagcaggaagctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtgcagtgaaggaggagctgaagtattggcagaagctccggcatgacttggagcgggcgcggctgctgattgagctgattcggaagagagagaagctcaaacgagagcaggtcaaagtccagcaggctgccatggagctggagctgatgccattcaatgttctgttgaggacaacactggacctgctgcaggagaaggatcctgcacacatcttcgcagaaccagtcaacttgagtgaggttccagattacctggaattcatatccaagccaatggatttttctactatgaggcggaagctggagtcccacctgtaccgcaccttggaggagtttgaggaggactttaaccttatagttaccaactgcatgaagtataatgctaaagacacaattttccaccgagcagctgtccgcctgcgggacctgggaggggccatcctacggcacgcccggcggcaggcagagaacatcggctatgaccccgagaggggcactcacctgcccgagtcacccaaattggaagacttttaccgcttctcctgggaagacgtggacaacatcctcatcccagagaaccgggcccatttgtccccagaggtgcagctgaaggagctgctggagaaactggacctggtgagcgccatgcggtccagtggggcccgcacccgtcgtgtccgcctgctacgccgggagatcaatgcccttcggcagaagctggcacagccaccaccaccacagccaccatcactcaacaagacagtatccaatggggagctgccagcagggccccagggggatgcagctgtgctggagcaggccttgcaggaggagccagaagacgatggggacagagatgactccaaactgcctcctccgccaaccctggagcccactgggcctgcaccttccttgtctgagcaagaatcccccccggagccccctactctgaaacccattaatgatagcaaacctccaagcaggttcctaaagcccagaaaggtggaagaagatgagctcttggaaaaatcaccactgcagctagggaatgagcctttgcaacgcttgctcagtgacaatggcatcaacagactatccctcatggcccctgacaccccggccggtaccccacttagtggtgtgggtcgccgcacatcagtcctcttcaagaaggccaagaatggggttaagctacagagaagcccagacagggtcctggagaatggcgaggaccatggtgtggcaggctctcctgcctctccagccagcatcgaggaagagcgccactcccggaagcggccaaggagcaggagctgtagtgagagcgaaggggagaggtccccccagcaggaggaagagacaggcatgaccaacggctttggaaaacacaccgaaagcgggtctgactctgaatgtagtttgggtctcagtggtggactggcatttgaagcttgcagtggtctgacgccccccaaacgcagccgtgggaagccagccctgtctcgagtgcccttcctggaaggtgtgaacggagactctgactacaatggctcaggcagaagcctcctgctgccctttgaagaccgcggagacctggagcccttggagctggtgtgggccaagtgccgaggctacccctcctaccctgccttgatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggcagtggcttccaagggacaaagtcctgcccttgggtgtggaagacaccgtggacaagctcaagatgctggaaggccgcaagaccagcatccgcaagtcagtgcaggtggcctatgaccgtgcgatgatccacctgagcagagtccgggggccccactccttcgtcacttccagctacctgtaagggcagggctggcctgcatccgcttgccctgcctccatcccgcagggcacagagaagcctcttctgcccctgccagatgtatggccggcagcttccccctctcatggtaggccagggactgggctttctccccactaagggcaaggccccagttttgaccaatcgcatggttctcctggcaggcctgctctgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttggtcagctgtggactctgtgacctttgtctaaacctgtgttgtaagatcttgggacttcctctctttctatgtctatctcttccccccaacactttctcttcttagtctctctctttatttttcaatctctgaatattttagtctctctctgagtctcattttttaaaatgctcttttagaacgggaaacggctcagatcctgctgtggcacggggcctatgtgtctctgtcgcgtctgctgtgaagcacatgatgctctatttattgtagagagtgactttatttgctttctagaattgtttataacagatggtataagagaggtaataaacagagaaaaatctatgcttgtaaagaatacaaaagttaattttacctactataatatgactgtctgaaacttattttctctctgagaaataaatgttctaatgggcaaaaaaaaaaaaaaaaaaaaaaaaaaaaaaaaaaaaaaaaaaaaaaaaaaaaaaaaggggggggggggcaaaaaaataccccggagggggccacgaaatagccgaccccctcttttgtgttgaaacaggggcgcccaaaagagggcggcaaaaaaagggagagaggcggcggggtacaacaaccgcggcgcgggcaaacagcggcgcgggactctgggaagagaccctcctcgtgcgggcgctattggggacaccacccgaagataagaggcccggaaataaaactggggtcacgggacacaccatatcggccggaatgccacgaagatgaatagcgggaa

SEQ ID NO: 13526 - DNA, 427 bp, Homo sapiens
aaaagtgattgcagatctaacgccgttggctgccatcctccactctgcccctgttcacaaatgtaggtgagttcaagcttttatctcttggcagaagagcacagagttaggaagcaagagtctcataagcatttgggactttctcagttcagcatatgatcggttgcacacaaaagtaagtttccctatcctttctcgtaggcttctgtgaaagtacagatgagctggaaaatgctgtatttcatgaacttcataataacaggatccataatttttatggaaagaagaatttgaagaccactacttgttttaaccccaagaataacttgctaaaatagggcacagagggaaaatatggaactgaactatatacattctttttagtcatcaagtcaattggcagtgaaataaaagattacatggagaa

SEQ ID NO: 13527 - DNA, 340 bp, Homo sapiens
ttccttgtgatgcataaatagtcttattcttcaatgatgtattttgaatcttctgcttgcatgctgtaccaagcaaagagaaagagtatatactcagtatttttagattcatctcgactggtatgcacaaactcagcaagataccatgcaaagtgtgacactccttactaggaatcctgaaagtcatattagataacacagctcagctgggtacggtggtgtgtgccttaatcccagctactcaagaggttgaggcaggagaatcacttgaggccaggagttcaaatccagcctgggaaactacagtgtgacctcatctcttaaacaaaacaagaactaa

SEQ ID NO: 13528 - DNA, 598 bp, Homo sapiens
tccccgggctgggggtggtggtagaaacggagggagtggaccgggtcttgggctcttgagcatttctcttgccacctctcagcctacctgaacgtgtgagacatggtgcagataggctgagaggcggcgggagagatgcccatgaactcaagtacccggacacgccctccacttctaccaccacgagtaacaccgcccccacgggaccgctctcgaggtcccccaagccaaggtgaggcaagtcccagttgaatgtcatcccgttcctcttgggcacggcggaccgctctcgcccttaaaggtgcgttgacgtggaaggtgaatgtctctttgcgtgacagtgcctcagcgcacgggcgacgaggggcacacctatccccctggctcgctctctagctggattcaggtggaacggaggaccatgaaccctctggaccttttctgccttggtcctatgcttgtaaggtttccggcctaagaggcccatcgactccttctgccttctttcagttgattacaaaataaataaataaataaataaataaataaataaataaataaaaaagcaggacattaaacctgccacctccagagggtc

SEQ ID NO: 13529 - DNA, 721 bp, Homo sapiens
gtgccgtgggggagcggtagatggcccagccccaagtgttccgatcttcctgcccaaacatattctgtgacggaaagcctatgttgacctcgtccggcactcaaggcgtgggcagcggcctaacgtctgctgcgggaacacagtcgcgttgaatgctattctcaagacagacaaaacagtgggaagacactacgccaagctgctaactccctggccattgccggactctttcacccccatggactttccgctggcattttaaacaacatagtttcttttctctgtctctttctctttctctctctctttctctttctctctctctctctctctctctctctctctctcaatctcataatttctctctctcgtgccacgttcccacccaacgctctctcgcccacttctactggggcccacttcctctcctgctctctctgtctcaacgtgattgactttcttgtgctgcccaggacttcttgcccacgtgcgccttcaaaacggtaagagctgcaactgaacgtgtgagacatggtgcagataggctgagaggcggcgggagagatgcccatgaactcaagtacccggacacgccctccacttctaccaccacgagtaacaccgcccccacgggaccgctctcgaggtcccccaagccaaggtgaggcaagtcccagtgtggagagagccagtgtggagagagccagtgtagagagggtcc

SEQ ID NO: 13530 - DNA, 449 bp, Homo sapiens
gtgccgtgggggagcggtagatggcccagccccaagtgttccgatcttcctgcccaaacatattctgtgacggaaagcctatgttgacctcgtccggcactcaaggcgtgggcagcggcctaacgtctgctgcgggaacacagtcgcgttgaatgctattctcaagacagacaaaacagtgggaagacactacgccaagctgctaactccctggccattgccggactctttcacccccatggactttccgctggcattttaaacaacatagtttcttttctctgtctctttctctttctctctctctttctctttctctctctctctctctctctctctctctccatgtgtgtaccccactgaaaatctttttgcagaactatttgggagttttagacagctttgccccctataggctcgtcgacgcggccgcgaatttagtagtagta

SEQ ID NO: 13531 - DNA, 1027 bp, Homo sapiens
gtgccgtgggggagcggtagatggcccagccccaagtgttccgatcttcctgcccaaacatattctgtgacggaaagcctatgttgacctcgtccggcactcaaggcgtgggcagcggcctaacgtctgctgcgggaacacagtcgcgttgaatgctattctcaagacagacaaaacagtgggaagacactacgccaagctgctaactccctggccattgccggactctttcacccccatggactttccgctggcattttaaacaacatagtttcttttctctgtctctttctctttctctctctctttctctttctctctctctctctctctctctctctctctctcaatctcataatttctctctctcgtgccacgttcccacccaacgctctctcgcccacttctactggggcccacttcctctcctgctctctctgtctcaacgtgattgactttcttgtgctgcccaggacttcttgcccacgtgcgccttcaaaacggtaagagctgcaactgaacgtgtgagacatggtgcagataggctgagaggcggcgggagagatgcccatgaactcaagtacccggacacgccctccacttctaccaccacgagtaacaccgcccccacgggaccgctctcgaggtcccccaagccaaggtgaggcaagtcccagttgaatgtcatcccgttcctcttgggcacggcggaccgctctcgcccttaaaggtgcgttgacgtggaaggtgaatgtctctttgcgtgacagtgcctcagcgcacgggcgacgaggggcacacctatccccctggctcgctctctagctggattcaggtggaacggaggaccatgaaccctctggaccttttctgccttggtcctatgcttgtaaggtttccggcctaagaggcccatcgactccttctgccttctttcagttgattacaaaataaataaataaataaataaataaataaataaataaataaaaaagcaggacattaaacctgccacctccagagggtc

SEQ ID NO: 13532 - DNA, 777 bp, Homo sapiens
gactagatgagaggagcctaggcaacagggctgtccacacacggtgctgaatacccaggtgctcaatatgaacattactccatggcactggggagccacggacgggatttgagcagagcaggaatctcccatcttcacttgttcctctcctccaccagtacatcatccggtgctcagaaatcccaaagctccccgcagtctcactcctcattgggggggtctggtttaatctcacggcccaggattacgtcatccaggtaggtgtccgtcataatgacgccacagtgatgtaatatgactggagttgagagggtggagcctggtagttggacatcactagggccggaaggggccacagaaacatttcttgtccccggggttgggggcggagagagcacggactcccagggaaatggtggttcctgcggcctggacacccagttgccgccttgtcgccttgcagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13533 - DNA, 1367 bp, Homo sapiens
acacccggctccccagcaatgtctccaccactgctgctgctacccttgctgctgctgctgcctctgctgaatgtggagcctgctggggccacactgatccggatccctcttcgtcaagtccaccctggacgcaggaccctgaacctactgaggggatggggaaaaccagcagagctccccaagttgggggccccatcccctggggacaagcctgcctcggtacctctctccaaattcctggatgcccagtattttggggaaattgggctgggaacgcctccacaaaacttcactgttgcctttgacactggctcctccaatctctgggtcccgtccaggagatgccacttcttcagtgtgccctgctggttccaccaccgcttcaatcccaatgcctccagctccttcaagcccagtgggaccaagtttgccattcagtatggaactgggcgggtagatggaatcctgagtgaggacaagctgactattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacagggaccctgaagtggctgatggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgctcagaaatcccaaagctccccgcagtctcactcctcattgggggggtctggtttaatctcacggcccaggattacgtcatccagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13534 - DNA, 571 bp, Homo sapiens
gactagatgagaggagcctaggcaacagggctgtccacacacggtgctgaatacccaggtgctcaatatgaacattactccatggcactggggagccacggacgggatttgagcagagcaggaatctcccatcttcacttgttcctctcctccaccagtacatcatccggtgctcagaaatcccaaagctccccgcagtctcactcctcattgggggggtctggtttaatctcacggcccaggattacgtcatccagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13535 - DNA, 345 bp, Homo sapiens
  misc_feature (67)..(67): n is a, c, g, or t
  misc_feature (73)..(73): n is a, c, g, or t
  misc_feature (75)..(75): n is a, c, g, or t
  misc_feature (83)..(83): n is a, c, g, or t
cctttttttttttcccccccgggggggggggccccccccttctttggggggggaaaacccaaatttnccgggncntttttttngcccccctttccaggtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13536 - DNA, 1667 bp, Homo sapiens
acacccggctccccagcaatgtctccaccactgctgctgctacccttgctgctgctgctgcctctgctgaatgtggagcctgctggggccacactgatccggatccctcttcgtcaagtccaccctggacgcaggaccctgaacctactgaggggatggggaaaaccagcagagctccccaagttgggggccccatcccctggggacaagcctgcctcggtacctctctccaaattcctggatgcccagtattttggggaaattgggctgggaacgcctccacaaaacttcactgttgcctttgacactggctcctccaatctctgggtcccgtccaggagatgccacttcttcagtgtgccctgctggttccaccaccgcttcaatcccaatgcctccagctccttcaagcccagtgggaccaagtttgccattcagtatggaactgggcgggtagatggaatcctgagtgaggacaagctgactgtgagtggcctttgactccaggaagcctcgagcctgggagaaccctgttgtctaagatcatctggcttagggaggggcttgaggtgcaggggcttcctgagccgatggatggggcttctcaaggagggggaggggttcctgggtgaagggataggaattctctcaagtccagaggcaaagtttgctaagcagttgggggcttgggtccagatgtccccagacctgggattaatgctttggttggagactcagacatgtgttgttgtctccaaattactagtccatttcatctacccctagattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacagggaccctgaagtggctgatggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgctcagaaatcccaaagctccccgcagtctcactcctcattgggggggtctggtttaatctcacggcccaggattacgtcatccagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13537 - DNA, 1862 bp, Homo sapiens
  misc_feature (119)..(119): n is a, c, g, or t
  misc_feature (124)..(124): n is a, c, g, or t
  misc_feature (212)..(212): n is a, c, g, or t
  misc_feature (217)..(218): n is a, c, g, or t
actctagaggttcccctctctccaaactgcatgctggtctaggatcctctacgcacaacgcctgctcgcctcctccgtgtggttgccaaccaagccgcctgctaccttcatcaccaatngcacncgctcctgcctggaatcctttttcctagcttcaccaccaaatcgtttagcgctccttccttcttcctagcttccttcaccaaatcgcnctggnnccttgactctgtctcttcttttgcctcctcaggcccagtattttggggaaattgggctgggaacgcctccacaaaacttcactgttgcctttgacactggctcctccaatctctgggtcccgtccaggagatgccacttcttcagtgtgccctgctgtgagcttctatgtgggagaataaggctgaatgggggtgaagggagaaggcggggctgggcctcagcttcccaaaggtttttgaggaactgttcttttctgacaccctcaaaggtcagaaggttaaaggggcagaaggcattcggaaagctcccctcccacagtgacacctctctgacttctgacctaggttccaccaccgcttcaatcccaatgcctccagctccttcaagcccagtgggaccaagtttgccattcagtatggaactgggcgggtagatggaatcctgagtgaggacaagctgactgtgagtggcctttgactccaggaagcctcgagcctgggagaaccctgttgtctaagatcatctggcttagggaggggcttgaggtgcaggggcttcctgagccgatggatggggcttctcaaggagggggaggggttcctgggtgaagggataggaattctctcaagtccagaggcaaagtttgctaagcagttgggggcttgggtccagatgtccccagacctgggattaatgctttggttggagactcagacatgtgttgttgtctccaaattactagtccatttcatctacccctagattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacagggaccctgaagtggctgatggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgctcagaaatcccaaagctccccgcagtctcactcctcattgggggggtctggtttaatctcacggcccaggattacgtcatccagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13538 - DNA, 1573 bp, Homo sapiens
acacccggctccccagcaatgtctccaccactgctgctgctacccttgctgctgctgctgcctctgctgaatgtggagcctgctggggccacactgatccggatccctcttcgtcaagtccaccctggacgcaggaccctgaacctactgaggggatggggaaaaccagcagagctccccaagttgggggccccatcccctggggacaagcctgcctcggtacctctctccaaattcctggatgcccagtattttggggaaattgggctgggaacgcctccacaaaacttcactgttgcctttgacactggctcctccaatctctgggtcccgtccaggagatgccacttcttcagtgtgccctgctggttccaccaccgcttcaatcccaatgcctccagctccttcaagcccagtgggaccaagtttgccattcagtatggaactgggcgggtagatggaatcctgagtgaggacaagctgactattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacagggaccctgaagtggctgatggaggagagctggtcctggggggctcagacccggcacactacatcccacccctcaccttcgtgccagtcacagtccccgcctactggcagatccacatggagcgtgtgaaggtgggctcacggctgactctctgtgcccagggctgtgctgccatcctggatacaggcacacctgtcatcgtaggacccactgaggagatccgggccctgcatgcagccattgggggaatccccttgctggctggggagtacatcatccggtgctcagaaatcccaaagctccccgcagtctcactcctcattgggggggtctggtttaatctcacggcccaggattacgtcatccaggtaggtgtccgtcataatgacgccacagtgatgtaatatgactggagttgagagggtggagcctggtagttggacatcactagggccggaaggggccacagaaacatttcttgtccccggggttgggggcggagagagcacggactcccagggaaatggtggttcctgcggcctggacacccagttgccgccttgtcgccttgcagtttgctcagggtgacgtccgcctctgcttgtccggcttccgggccttggacatcgcttcgcctccagtacctgtgtggatcctcggcgacgttttcttgggggcgtatgtgaccgtcttcgaccgcggggacatgaagagcggcgcacgagtgggactggcgcgcgctcgccctcgcggagcggacctgggaaggcgcgagaccgcgcaggcgcagtaccgcgggtgccgcccaggtgatgcgcatgcgcaccgggtagcagagctagcgctactcagtaaaaatccaatatttccattgaaaaaaaaaaaata

SEQ ID NO: 13539 - DNA, 1068 bp, Homo sapiens
acacccggctccccagcaatgtctccaccactgctgctgctacccttgctgctgctgctgcctctgctgaatgtggagcctgctggggccacactgatccggatccctcttcgtcaagtccaccctggacgcaggaccctgaacctactgaggggatggggaaaaccagcagagctccccaagttgggggccccatcccctggggacaagcctgcctcggtacctctctccaaattcctggatgcccagtattttggggaaattgggctgggaacgcctccacaaaacttcactgttgcctttgacactggctcctccaatctctgggtcccgtccaggagatgccacttcttcagtgtgccctgctggttccaccaccgcttcaatcccaatgcctccagctccttcaagcccagtgggaccaagtttgccattcagtatggaactgggcgggtagatggaatcctgagtgaggacaagctgactattggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacaggtgctggggagggtgcacctatctatgagtcctattcctcagaaggaagtgaggccctccttcaggaagtctcttactccataaagaaagtcccagttcaggcacggtggctcatgcccgtaatcccagcaatttgggaggctgaggcagattgatcacctgaagtcaagagttccagaccagcctggctaacatggtgaaaccccatctgtactaaaactataaaaattagctgggtgcggtggcacatgcctgtaatcccatcctattctaatagcctaagccattatccctgtttagaccggggtgatagatcttcaaccatacaatgatttttactccgctatcccgtaatggataatgagatggaccctatccgaaa

SEQ ID NO: 13540 - DNA, 588 bp, Homo sapiens
attggtggaatcaagggtgcatccgtgattttcggggaagctctgtgggaatccagcctggtcttcactgtttcccgccccgatgggatattgggcctcggttttcccattctgtctgtggaaggagttcggcccccgctggatgtactggtggagcaggggctattggataagcctgtcttctccttttacttcaacaggtgctggggagggtgcacctatctatgagtcctattcctcagaaggaagtgaggccctccttcaggaagtctcttactccataaagaaagtcccagttcaggcacggtggctcatgcccgtaatcccagcaatttgggaggctgaggcagattgatcacctgaagtcaagagttccagaccagcctggctaacatggtgaaaccccatctgtactaaaactataaaaattagctgggtgcggtggcacatgcctgtaatcccagctacttgagaggctgaggcaggagaattgcttgaatccgggaggtggaggttgcagtgagccgagatcgcaccactgctctccagtctgggtgacagagagagaccgtctccaaaaaaaaaaaa

SEQ ID NO: 13541 - DNA, 499 bp, Homo sapiens
tcatactatcataggaatcagcaaagaaaatcatttcactataattctattggcattttaagaacattcaatggaaaacataaatttccaatttattaagaccttatttttgtacctaattattaaagagtaataccatctatgttctctaacagccccttcctaatccattgctttattaaatactcttctgattatgtctacttgataccaagcattatcaaacacttaaataatgaaatgaaatattttcatttccctttttgtttatgctgtttcttaattgttttatgagaaattgatatagttcaaagataacaaatgtaaatctaaaattaagatgaacacttgcattaatttattaaatacataaaattcatagaggtccaaggcaattagtgtgttgaaaacaaatattaatatatacaggaagttcaagggttacaactctttatgttacctggaaatgtaggagtagcattctctttttaaatttttg

SEQ ID NO: 13542 - DNA, 489 bp, Homo sapiens
caaaacctccagaaagaaccaaccctgttgatatcttgattttagatttctagcctccagaactgtgagaagacaaatttattttgttttaaaccacccactttgtggtacttttttacagtagcccttggaaactaaaatactctgtttcagcctctctagagaagaaagtcagacttctaatagaatgtgagaaaactttgtatcaagtaggagacctgtaaatctaatgattttataaacttttaaccagtcattctattttcttcacatcttcacaccctctcctcctgcagtaatacctttttctgtcattttctgggctctttgggggttcatcagtgacaatcaggttgcttttctggtctgtcccctattgaagtagaattccccattcttttctgttaaggcgcttttcaagtgttcatctcctttccaccttctggaatttacttgcttttttctccttctgtcctgtgggtttatgcc

SEQ ID NO: 13543 - DNA, 524 bp, Homo sapiens
ggatacaatccctagaacttgcgcaaatttctcaggtaaaaccacatgtgcatttgtgtgtatatacaactgcacagtcactgccgggctccttcatgctgctgtgtgtagctgcaccctgacccctggcaaccatgaatgtatttgaatttccaggaatctgttctccctccctatgattttgtcatttcaagaatgttatgtaaatggaattatacaatatgtaaccttttgagtttatctttttttcactcagcataatgcccttgagtttgcacctgacatttgatagttcattttattgctaaatagaattccttggtatagatgtgtcacagttggttaaactagtcacctgttgaagaacatttgggtaatttccagtttttggcttttatgaataaagctgctatgaacattcatgtacaagtttctacatgaacataagtttccatctctcttggatcactgcccaagagtacacttgctgggtgatttggtaagttcatttttagtttaaaagg

SEQ ID NO: 13544 - DNA, 523 bp, Homo sapiens
gcaggaccgggccgctgggccctcatgtgggagagaggtgaaaagcgtcccccactagggggctggcagtgcatgtgcttgagttaaatgtgcagggcagacagagccagaagggcctgtacccaggggctcgtcccctcctccggtttcccagacaaatccagacaccagcctttagggtggccttgggaggagagggccaggctgtcctgggtgtgagagaactagatagagcctcccaaccctgatttagaaatgcattccttattttgtctagaaattaataaatgaactagcttgttttgacaggtttatttcacatcctatgaatgtatgtaaataaactgtacataggtccatccacataaaatatcttttaataacatatcaacatttgtgtaaatttgaaatttaaaaaaatctatgaagctggtgtacatatgttacaattacgtatattttctttggtccttcataaaaatatatttactttgccaataaaaagaaaaagaactcacaaaat

SEQ ID NO: 13545 - DNA, 471 bp, Homo sapiens
gagaacccctcctatatccttccttcttttcctgtgctttgtacctctacagcaccacttatccctgaatcacttctccacaaagtcattgatacctgtaacaaaatgccataaactggaggctggggagtctgagaccagggtgccaacacggtcacgctttgatgagggccctcatttgggttacagactgccgacttctcaccgtgtcctcacagggcggaataacaactctctttagcccctcatgaaggcactcatcccatttggagggctctacctcatgacctcatcccttctcagaggtcccaccttctatgcatagtatccgcacattagggattaggtttttatatggatttggggggcacagacattcacatcacaatggtgcctcttacatttctcaagcacttatttttgctctgtattatggggataaaaatgattctgatttaagttgtaccttta

SEQ ID NO: 13546 - DNA, 346 bp, Homo sapiens
tactaacaaccccttcattgattgaatgtggaacctaaattaaggagtcaaaggaggccaggtaccttggctcatgcctgtaatcacagcattttgggaggctgaggcaggtggattgcttgagcccaggagcctgagacccacctgggcaacatggaaaaatcctgtctctacaaaagaaaagtagaaaaaaaaattatccggtcttggtggcgcaggcctgtggtcccagctactgaggaggttcaggcaggaggatcatctaagcccagggaggtcaaagcagtagagctgtgatcactccacagcactccagcctggacaacaaagtgagaccctgactcag

SEQ ID NO: 13547 - DNA, 680 bp, Homo sapiens
tggtactcaccgcctcatgacccctgtttctgactgaggttccccccagcttgaatcttgtagggaggcaaggagcagagaacaggccctgccctcacgttggtccacatggccccctgccactggctggccacatgaccttgggcaagtctcctgtaccttccaggccccagattcctcatctgtaagatggggagtaatgactcccccgtgctggggttgcacgtgttggcggagatggacaaggagccccttctagcaggcaagctctttccactctccctgcccctcgtagtggcccctagatgtgctggctggtccccatcatgcccagttcgccactcacagagccgagggcagagaggtcaccaagttcgtaccgtctgtgctacagcccatccccaagattgcatctccccagaaggtgcagtggaagaggagatagtggggggttgaggctgtcacagaaggtcagagccagagggtcctctaggacatggaggccaagccttccttttagagatagggtaactaaggccctgagtgggcaggtggctgcacagggtccccattactggctgccggctcccagtccagtgctcctctcactacacctacgcctctccctaagttcgggaggagttccaggtgcccgtgccccttggtgttcactccccttt

SEQ ID NO: 13548 - DNA, 4600 bp, Homo sapiens
ctgacgttgtgattctctcgggagtttgaagacagaaaggaaaggggagaaacctgcagagagcatcaaaggatggggggtgctataaaagaagcaggggggtcctttgaaagaaatctatcatgcactgaaatgctttctggagaaggtgccgttattttcctcccctcttgctcagatgaaaggagccagcaaggacagtcctgaaatattcctcaggggactttttgtcattgttcctctttcctcttgcacagagctatttgctgacctttccagaggaatctcagtccagctgagaagacagttcttaataaaaacaaaaaaatgcaaaaaccaattcctgctgtttgaatgggaatggtagcttgcttgctgcagttcttttcctgtgacattttggaatgtctgcagaaacttaaaaaaaagaaaaaaaaaaccttaaaaactccctggattaggcaagagaaaaggaagtttttttttgctaaacaggagtaaatgagaggtggtaacttatccctaagccaggacctggatgatcaaaaccttcaaattctagggatcagcacttcaaaaataacaagtaaacaagcatgaggagtggctgttgggtttcgctcagaggcaggttttaaaggaagccaaaaccgggttcagaacttcaggcctgtacgatgcctgaagaccggaattctggggggtgcccggctggtgccttagcctcaactcctttcatccctaaaactacatacagaagaatcaaacggtgttttagttttcggaaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13549 - DNA, 440 bp, Homo sapiens
attttatattttagaataacttcaaaagcttagttttaaaagttggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacaggtagatgtcacaattttactagccatcttcactgagaaattcagactcaactgacaggatgcagtgagctgaggaggcataaccttgattgatgtggtaacagtttacaacatagattatttggccacaggagtttgcattgtttctattaagttacaaagtcaaaaattgggcaccttagatatct

SEQ ID NO: 13550 - DNA, 698 bp, Homo sapiens
  misc_feature (108)..(108): n is a, c, g, or t
  misc_feature (628)..(628): n is a, c, g, or t
  misc_feature (664)..(664): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttggaatatttgacaacgtctggagacagtntctggcttgtccacagttgggggaagataccacagntatcttcgtggggtagaagccggggtgcatttaa

SEQ ID NO: 13551 - DNA, 392 bp, Homo sapiens
  misc_feature (56)..(56): n is a, c, g, or t
  misc_feature (75)..(75): n is a, c, g, or t
  misc_feature (88)..(88): n is a, c, g, or t
gggcgggccgccggggcggcccgcccgtttttccccgcttttcgaggtgttaaagnatatataagacagtgaaanatttgccagtggntaaatacaacctcctcagtatatttgcaggtttcatcaaagacatttgtaactgaattctgttagaaaaataattgtgccagaaaaataattgtgcctggaaaatatacctctcaatgtataactcaagacctgggatgggatatgccatatatgtgctcctgtttaagaaaccaaatatgcaaaattgaaacagaataaatttaaatagagagtgatgattggcactacaagtcactgcagggtgtcttacatgatagcttcccagtccattttaaaataaaattcaaagttttaattgagta

SEQ ID NO: 13552 - DNA, 4634 bp, Homo sapiens
  misc_feature (3)..(3): n is a, c, g, or t
  misc_feature (11)..(11): n is a, c, g, or t
  misc_feature (24)..(24): n is a, c, g, or t
  misc_feature (33)..(33): n is a, c, g, or t
  misc_feature (41)..(41): n is a, c, g, or t
  misc_feature (56)..(56): n is a, c, g, or t
tanagtaggantatcttaaccccntactattcngcaagaanccgacagaatggggntttttgaagacagaaaggaaaggggagaaacctgcagagagcatcaaaggatggggggtgctataaaagaagcaggggggtcctttgaaagaaatctatcatgcactgaaatgctttctggagaaggtgccgttattttcctcccctcttgctcagatgaaaggagccagcaaggacagtcctgaaatattcctcaggggactttttgtcattgttcctctttcctcttgcacagagctatttgctgacctttccagaggaatctcagtccagctgagaagacagttcttaataaaaacaaaaaaatgcaaaaaccaattcctgctgtttgaatgggaatggtagcttgcttgctgcagttcttttcctgtgacattttggaatgtctgcagaaacttaaaaaaaagaaaaaaaaaaccttaaaaactccctggattaggcaagagaaaaggaagtttttttttgctaaacaggagtaaatgagaggtggtaacttatccctaagccaggacctggatgatcaaaaccttcaaattctagggatcagcacttcaaaaataacaagtaaacaagcatgaggagtggctgttgggtttcgctcagaggcaggttttaaaggaagccaaaaccgggttcagaacttcaggcctgtacgatgcctgaagaccggaattctggggggtgcccggctggtgccttagcctcaactcctttcatccctaaaactacatacagaagaatcaaacggtgttttagttttcggaaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13553 - DNA, 4138 bp, Homo sapiens
aagagtttatatccccttctacaagaaaacttaaatatagctaccaccgctttgaaaggaatggtttgtgtccaaacagcattttccagacaagctctgtacttttttgccaaaagaattaactttaaactgaaggcagtggacagttaaacaagagtcggcactgggaacagctgtgcgtagaccagaccagtgacttataaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13554 - DNA, 2360 bp, Homo sapiens
ttacatcctttaaatcattgaaagggctttattccaatttcctaagcatcataaagagtttagaaaatatttgtatgtctcttgcatttcaagtgaataaaatcactttatctcttactcttgcgtccccaccccccacccccccccaacatcctttgtagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13555 - DNA, 1266 bp, Homo sapiens
  misc_feature (108)..(108): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatatcacatcaactatgtgtacctagaacagtccttggatggttgacgtgcttgataaataaatatttgttgcatgaatgaatgagtgaatatttagagctctatgtcaaatttctggttcagatgttcagggatgttctcagttggaccttttaataaaaaaacaataaatg

SEQ ID NO: 13556 - DNA, 1113 bp, Homo sapiens
  misc_feature (108)..(108): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccagaggtctacttttccattcagtctgctagctgcaaggaggtttcatcttttggtgaagaagttctcaagtaatatagacggatattttcaatactgttttagagagagccatgtcttcaagaccaggaagtaacagataaaacctcttctccaacattgctattctaaatcatctgtttcacatgcagtgcgtatgacataatggcttttgatgaacaaagcctaagaagtttaagactgtgtaatatggaatatgaaggttgtcctttcaaacaaatttataggaaattcaagcttgcttctgtaattatggacttaaatatagtatgtgagtagatcatttgaaaagatgcttcctgaattattaatacagtatgtaatagctgctaaattaggttttataattctaaatcatcttacggagtg

SEQ ID NO: 13557 - DNA, 4622 bp, Homo sapiens
  misc_feature (108)..(108): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13558 - DNA, 4135 bp, Homo sapiens
cactagtgctggggagcgagccgtggtttccattcctgggtgatggagtcatgggagaaactgcagtgagcaaacacagtaggacctgagttgggctcgaatgtgctttaagcgactcaggacagagcagctgctctgtctcccagcttgcaagtgcagcctgcatttgtcactgaccactgaagtgtatgtttgtgcaaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13559 - DNA, 4551 bp, Homo sapiens
  misc_feature (108)..(108): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccggccgagaaaagaaatgacatgctacagaaagaaatggagcagtttttttccacgtttggagaactgacagtggaacccaggagcaatatggattcagtgagcctgctttcgcctgctgtctctgatggctctggcaaggactccagggattctggtgggatatgacttagctggatgtacagaagtctaactggtgaaggaatatcatttacagacattaaacatccatatctgcaatgtgtaccaaagttatatcatgcctgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccaaaaaaaaatta

SEQ ID NO: 13560 - DNA, 1501 bp, Homo sapiens
  misc_feature (108)..(108): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcaggtttcatcaaagacatttgtaactgaattctgttagaaaaataattgtgccagaaaaataattgtgcctggaaaatatacctctcaatgtataactcaagacctgggatgggatatgccatatatgtgctcctgtttaagaaaccaaatatgcaaaattgaaacagaataaatttaaatagagagtgatgattggcactacaagtcactgcagggtgtcttacatgatagcttcccagtccattttaaaataaaattcaaagttttaattgagta

SEQ ID NO: 13561 - DNA, 1102 bp, Homo sapiens
  misc_feature (108)..(108): n is a, c, g, or t
tagtagaggcctgggtttaaatcggcgaggattctcaagtgcatgtggcaacacagcccagctccgggtggaaaccagcagggctctggaggggctcggagaccaggngagctgtcaaggctgcggcggggaccagagaggagcctggcgggggtggctgggtggctgggggaatccccccaacttcccatcgcaggcgcactctctcggccgcctatttcctccgaaacccgcgctgcggagcgcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggtaagatattttcctagtctgattaaattattgtcatcctgtgttggtaaaggtgaagatgggtcagacaggtttcattcttttttgaatcatgactgagaaccttaatttgaggcttggttagtgttgacgcagataatgactgcaggtttatatactagtacaaatgaatgcactcacacacacatactctgaccacataactactagattttcatttgtccatgagactccatagttgaccacaagtcatgatacagtatttgttcaggactattggagatgaatttgattttacagcgctcttgtgatgtgaaatttgacaaggggttataggttgaatgctttgcccagtggaatcactgacatatttcctcacaaaattgtatcttcaaggaggttttgcaaaaaaca

SEQ ID NO: 13562 - DNA, 4220 bp, Homo sapiens
atgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcactcgccagtgtttcggcacaaagagatggtcttaaaaatatcagaaaatacagctgaagggacagcatttagactagaaagagcacaggatccagatgaaggtcataacagtatccaaaactacacgatcagctccaactcttttttccatattaaaattagtggcagtgatgaaggcatgatatatccagagctagtgttggacaaagcactggatcgggaggagcaggaagagctcagcttaaccctcacagcgctggatggtgggtctccatccaggtctgggacctccactatacgcattgtggtcttggatgtcaatgacaatgccccacagtttgcccaggctctgtatgagacccaggctccagaaaacagtccagtagggtcccttattgttaaagtgtctgcaggagatgcagactcaggagtcaatgcagaagtatcctattcattttttgatgcttctgaagatattttaacaacgtttcaaatcaatcctttttctggggaaatctttctcagagaattgcttgattatgagttagtaaattcttacaaaataaatatacaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacaatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacagacagagactcaggcaccaacgcccaggtcacctactcgctgctgccgccccaggacccacacctgcccctcgcctccctggtctccatcaacgcggacaatggccacctgtttgccctcaggtcgctggactacgaggccctgcaggctttcgacttccgcgtgggcgcctcagaccgcggctccccggctttgagcagcgaggcgctggtgcgcgtactggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgagcggcaccgggaccctgttccagagctaccagtacgaggtgtgtctgactggaggttcagagaccggcgagttcaagttcttgaagccgattaccccccacctcccgccccataggggtgggaaagaaatagaggaaaattctactctccccaatagctttggatttaattattgaaaggaacccacttaataaagacatttacttctttaatatattcttgttggctaactaaattgtgtatgcccaccacaaagaaggtactattttttgtttgattcatcttcaactttgcgtattatgcttaacttcacaagttaactttttcttattttgtatcctgatgaggcatttcttactagaatcccataagtgaaatataatatttttcaaagttgatatcatttaaaaatttttggtcgttttaaatgtctttattgactttaaattcattgcctctacattattcattagttcttcttttcctaaaactttttacttgttaaaatagtctgctgcatgtaatatgtgcttttactatttgatatttcttctatttttcttttgaaaccggtgttcttattggtttgccatccttgttcattacaactgttttttgtttgtttgtttgttttttggtttgtttgttttttttttttttgagacggagtctcgctctgtcgcccaggctggagtgcagtggcgcgatctcagctcactgcaacctccgcctcccaggttcaagcgattctcctgcctcagcctccagagtatctgggactacagttgcatgtcaccacgttcggctaatttttgtattttcagtagagacgggtttcatcatggtggccaggatggtctatctcttgacctcgtgatccaccccactcagcctcccaaattgctgggatttacaggcatgagccaccgcacccagcctacaataattttcttaaactttaccttttattttaaagttctagtttcccggcattgatagttccctatttgaaatataatgtttctcttgtaagtgatatgataaataaacccctaattagccttagaagaaaaaccactgcaagatattaagcgtgtgtaaatgggctttagtctggaaaccaaaaaaaaaaaaaaaatttagtcattctataggatcatgtgaaaatatttaatttgctccttttaattctgtataaacaaatcagaggttcctgaggttcctgttaaatttttaatggctaatagcccagtgccatccagttgaaaaaacaacagcaatcacaaagtagaggtttatattgtgcggcttttatattcagctattagagtgttattggtagtgtctagccttttcctccacgacattccttgacttaatccatttgggcctattatagacaaaatagagcttctttctagatataaggtctttgaggcagggctcagtggctcattcctgtaatcccagcactttgggaggccaaggcgggcagatcaccttaggtcacgagtttgagaccagcctgaccaacgttaagtaaccccgtctttactaaaaatacaaaattagccaggcatggtggcacatgcttgtaatcccagctactcgggaggctgaggcaggagaatcgcttgaacccaggaggtggaagttgctttgagccgagattgcaccattgtactccagcctgggcaataagagcaaaactccatcaaaataaaataaaataaaatataaaataacttaaaaagaactttgaataaaattctatgaaaaaagacactagaatgctgttcttaattttaatagtgttaagataggtgttagtgtggtctgttctttacctccctttatttggtgcagagaagttagatcctgctaaatttcaattaagaggggaccttaaaataaggatcaatctcttatttaaccctgtaagttactttaaagctaatacaagaaaaacaaagacaagtgaaagtaaggaaacagaaattgc

SEQ ID NO: 13563 - DNA, 422 bp, Homo sapiens
atgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagacaggagaatcacttgggcccgggaggcagaggttgcagtgagccgggatcttgcactgcgc

SEQ ID NO: 13564 - DNA, 562 bp, Homo sapiens
gtagctacttggagggtatggcctgcgataacctgacacaggcttccaggacactgttagaggtgatcgccatcttcatgggcagtggggcagtcctttgtacatatgcagcctcacgtttgcctttattttcccggcttctgctccgtgatgcaatttcctgtccataaatggtgcagatctaattccctgaccaccatatagtaaaggtttactttgacatattgtccttcctaaaaagaaattttactgcacagttataattatcacatttttcttaattagcaacctcttctgatttctttttcatcttctagttttataaaacattttctttatcttattttaacccaacttactgaattctatgactattttcttagttccttttttttgtacttgataagatctctgagctactctttactgcttagatttttcaagtatatggtattatatcttgattttggtgtaatctcagaactccagctattcttccagtctatgggtagaataattatgtcattagagacattggagcctgcctctcccatgacggcca

SEQ ID NO: 13565 - DNA, 321 bp, Homo sapiens
gattcaggcaggaaaacattccaggtgttatgcttcttcaaagagggcatgaaagtgaaaaatggtcttgtgtcattgtcactgagttgtttgtatccagcacagtgtctggtgtataataggtgttcagtaattatttgtcacccctcactcattctatacacaagaattaactcaaaatggaccatagacctaaatgtcagagccaacattatacaacttttagaataaaatatgattaaaccttcatgactttgggttaggcaaagacttcttaggtgatgccaaaaactcaagtgacaaaagaaaaatagataaatt

SEQ ID NO: 13566 - DNA, 412 bp, Homo sapiens
catttaaaaacttaaattatgatccaggtccttaaaaaaaggacataaatgtactgtacaattgaattttatgaggtgccccaatgtactataaagtatacatagagcatataaaattctaactccgctgtatcataaatttgacctcactgaaatgaataggctcactgtatggcaagcattaatgaaacgtttaattaacattcccttcacttgcatttttagaattttaaagggcttcctggggactatttcaatggctgaggtttttgcaaaacaaaagaacaaaaccttctcataaaaactgatctcttttgctcaataactcctccaatagagacatttaatttaattagactgatgaacctgaatttgaattttatacccaaacctatgatcatccttaaaaaaa

SEQ ID NO: 13567 - DNA, 423 bp, Homo sapiens
accatagactgagggaaggagaatgcctagatattttgaggactgttatagaaggagtttgagttaataatgacacccaaagaccctgttaaagtgggaacacatagggctcagggaataaaaggaatcctagaaaagcttacagtaggtttacagggtctgcagaccccctggatgttattttcccagtcccaagatattacaataaaattaagctcaaatcaaagattcacctagagaaggattctgtttgtccagcctttattaaggttttagtccagtagtgaacctaaatgtcttgaagcaaaatcgttggctctgttttaataaactgctagaggcatactaattgctttctttttccatgcactctaggatatttatatctcagcctttttgacccacatttgatgctccatcctt

SEQ ID NO: 13568 - DNA, 401 bp, Homo sapiens
gcaagagcaaaaattctgaaacaggaggtaagttagtgttttcaaggaaaagctggagcttttatctgaaaatcagattctgaagctaagaaccaatttgaaaatacaatacaatatcacttcgactaggaaattatggcataaaccaggagtctccaaaagctttttgtgtttacttaaaaattcatacaaaatttgcattctaggtcataatatactaatttaattggaggaaacaaaggcactggtatgatatcatcatgcctactttattcatccgtgtatccccagaatctagcacagttcccgattggtatttatagtagcatattggttgaataagcaaggaaggaggtgaagggagggagaaggagagagaagcagagagggagaggaaagga

SEQ ID NO: 13569 - DNA, 297 bp, Homo sapiens
tataagttcaacttaagtaaaacatcaagttactatttacacatatatggtaaaaaaaaaaaatgactggcacataagtgagtaaggcttagaagacatggtatgaactaaatatgactatttttataattctgagcaaatgtgattgttctaaagattaaagtgatttttattcatcaattgtaaagtttctagcataaaaaaggtagatttatgaaatacaaatccaaacttctaacctaaggacacaaaagtcttggtttccagtaacttattttcaggacacagagataaaaa

SEQ ID NO: 13570 - DNA, 861 bp, Homo sapiens
ccttttttattccccccagcttctggggggaggcatattcaaactaggaagtttgaatagcagtaaaacacacatttttataccctttacaaagatctattccttccattttctttctccttccattccccaaatccttctttctcatagaaacatttcaaaatatagatgagtctttcaatatttcagcatacgttttctaagaatcaagaatggtctcttacataatcaacactattatcacacccaagaatattaacaggaatttagtaatattatttaatatatgattcataattggatttctccagttgtctgtagccgtctttttgtattttgtttttccagttcaggattaatttttcatttggttaaatctgtagttttttcaaatttgaaagagtacctcattcatgttttttgttttctataacactaatttaacttttcatgttgcagtaatttcagatttacagaatagttacaaagatagtataaatcactcttatgtacgctttacccagcttcctcaaatattaacatgttatagaactgtaccacagttaacaaaagtagacagttaatactggtatgttattactaactaatctgtagaccttactcaaatgctgtcacttttctcacaagtgtcctttttctggttcaagacagttgaggcctccacgttgcatttagttggtgtgtctcctttgtctcttgtatttaatcagtgtataaatttgtatttaatcatcttgacaatttagaagagtgccagtctgtaattatgtggaatgtcttttatttttgagtttgcctaatgtttcctcatgaataaattaagattattcatttttggca

SEQ ID NO: 13571 - DNA, 420 bp, Homo sapiens
atcactttgacaccatcataaagttgaaaaattccaagtcaaaccattgtaagtcaggggctatcagtattcagtggtaaatgctggctctaactattcttccaagtcagtggttgactgctgtttattctataaagggttacaatttatagattctctcacttgtagaatgagagattcagaattaatagcagacagagtccctaccttgatggagctttcatttaagtgtgaaagtcaggtgacctaacaaggccttggcataagtttaggatttggattgttatgggagcttgggtagggacatgtcataggtaaggcaacagcaggggtagagataagcttgacatatgtcaaaaatcatgaagacatcagtaatccttgaagttggctgaaaggtatagagttgagaaagtagtt

SEQ ID NO: 13572 - DNA, 607 bp, Homo sapiens
atattgcacctatagtcaacaatactgcagtgtacactgaacaatttgttaagatagatctcaccttgtgttcttactgaaaaaaaaaaagaaagaaaatagaacagaaaagcaattggattttaattctggaaactcctttctcttccttacatccaggaaatttgctgtttattttgaaaagcaaatttaaacctatttaagggagagagagctcttgtaaaaattcatttattagttctggaccaatgttatttataagctattatttcaaatgataaaaaataaatgcataatacatttgatgatagaacatttttctttttaaataaggcctgatttttcaaaaagcattgaatatgtttgtttctaatttccaaagcttgacagtttcttatgtttcattaaaagcagaagaattgttatgtatgcatgttcatatcacttttgaatgactcatgtggctacaaatgcagcaatctgtggttatcatggaccatgaactagataaacattcctgcttttcttaacattcctttcctgtgcctcattaactaatgtacataataaaacatctttatttcattttctttgcaaaagcaaaatg

SEQ ID NO: 13573 - DNA, 436 bp, Homo sapiens
tcatttcagatcgtcttttgccccaactttgccccaagtggctgtggattggatttgatctcaccagtctcctctttcttgctcgtctcaaaggaagacctgcctattatctccctgcttttttgttattacagaaaaactgagaatgacaaaaacataccttggaaaatttattatgaaatctgaaatgtgacatgttacaaagttcataagctccttgttccatagtatattgttatctccattcttaggatattctgttgtgatactgttttctgctttttattttgaagttggtacttatccaggccctcttaccattttaccattatccagtgaaaatttatggattctacctttatgtgtgctccttctgcccacagtggaaaatgaagataatccagatcacaaatgaaaagtatgtatctttgagcca

SEQ ID NO: 13574 - DNA, 415 bp, Homo sapiens
tatggtcaatttaacaatgatactgttcctgttgttgaaataacgtttgccaaaagttatattctagatattcttaaattaaaagagtaatattcttattgcaataaagttatttttatgtatttcacaaacaactttattgaatattgaaagtttttaaataagaacaccaattatagcattctttgcactaaaatcctctagaggctcagatttttacttttagttttagaataaagcagtgaaacctctttctgcttttaacagatctttttttttctttatccactctcttttcttcttttatagcatcccttttcaccaattattttcatttctcttatttttttaacttacaactttttattagagcttttcctctgtcttcaaatatgcttaaaattcttctgtcctc

SEQ ID NO: 13575 - DNA, 388 bp, Homo sapiens
ggatactcaagctgtagaaaccaaaatggtaaggaaatcatcttcattttcatttagaaatgagttttgcaaaatacaaaatgtcaaataggttcatggctgtattatttttgtgattaattatcaagactgaagatttgacctgaaagcaggaaaaaaaacatgaataaaacatattatcacatatgagaagtggcgattcttattgctgcctacactattccagcttcaataaccaaagaacaatattgaaggtggcatttcagaatgacatacagtgtcttttctggaaggaaagaaaaatgttgctacctacaaatgttaaattgggtcacatttttgctaagatttgacaaggactagactaagattgactctgcttattgtg

SEQ ID NO: 13576 - DNA, 349 bp, Homo sapiens
ggaaaattcaccctgctccagaatccactggcttaaaattccctaattggattggaaaataaaccaaacaaaccaacaggaagataaatattaccaatattttgagtcaattctgtcttgaattcatcaaagccaaaggtactaatatctgtgtttatgctgttcttagggtttctattttttgtttgttgtgttttgtggttgttaattaactgagcattccttcaatctctaaatttcttaaaaatatcaagtgtgtcttgtgaccaccatcagctgcaaacacagcatcaacttaccaaaacagtctttggtgattaatccataatgacagggctgttctcccgac

SEQ ID NO: 13577 - DNA, 326 bp, Homo sapiens
gattcctacctaggcctactgcacacaacagtatgaacgaggtatgaacagttaaagaaaggggagagaataggattcactcattacatttttcttttggatttctctataaaagtggagtctatagaaaatggcatcaattccattacaaagctactctcaacaagaacaaggttagaaggaaatggaatagattcatcagggttgttggacaaaataagtataaaatcatcttagcactatgcttagcatgtagtaactgctcataaatgcttcactgatatgacttgtctttgaaactctcaagtacagagtccatagtggtt

SEQ ID NO: 13578 - DNA, 563 bp, Homo sapiens
agaaaagctgagcatgggagacatgccccaccttttaactcaaccattataagcctgctggctttctgtgcaagccctcttcatgttaataggctacatcaaaggagaccaggagagttaatggcgcccatcacatagtgaagtaatcccatggtgagctcttatggaggaatctgagtccagatttggtgtgatagggttactaatacaggattcaatggttatgtttggggacagtcctgactttttatatagaaatcacctctctgaagtatactagactcaccgctgcaaaaactgccttcatagtaaaacaaatagagcctaacccgaagatttagcagttgctcgtacacagctgaatctgtaactacagacatgtgtttgggcctgcctttactgctcgctttttgggtagggctgcccaatggcccagtaagttctttggatttaacaacattgtggaagcaactaggttggggctctttaagtgggcactgtccaaaattccagaattccaaatctttgaaaactactgaaatagaaagaagcacgcaatgagt

SEQ ID NO: 13579 - DNA, 458 bp, Homo sapiens
acacaaacttcattttcaaatgaaaatgctatcagatgtttgacgttacaggttaaagcattttcacatctgtcttacttcgcaacttctctaaggtgggtattaatcacattttacatatgtgaaaactgagactcagtttaaataaatggcttgccataagtcatacagctaataagtggcagcactgggccatgaagagccactatctcttcaagatctctttttccccctcagtaatacacagctgcatcacctatgacaaatgcccattgcccagtataactttgtggggaagaatctctttccctaagttgcacccttctgacaactcaaactgtagctgtcagggctggatttttttttttttttcatctcctgccggaatggggttctctgttaattttggagagggggtttctgagaaaatggcaaagggtactgtttgtatgacatgg

SEQ ID NO: 13580 - DNA, 3007 bp, Homo sapiens
ttttttttttatattacttttgtttaaaattggttttgattcatattttattatatacacaatttattagcttcataatttaccatgcaagattttagactgattaggaaattcactaggaagagtagcaggtataatgtttgtatcatattaattttattattgtcttttatttttattaaaaattttatttcagtagtctttttttattttattaaagtatatactggtttttggttacatggatgaattgtctaatggtgaagtctgagattttagtgtacccatcacctgagtagtgtacattgtacccaacttgtagctttttatcccttaccctaccttccaccctccccatttggagtctgcatagtccattatatcactctgtatgcctttgcatacccatagcttaactcccacttataagtgaaaacacggtatttggttttccattcctgagttacttcacttagaataatagcctccagctccatccaagttgctgcaaaagacattatttcatttttttatggctgaatagtattccatggtgaatatataccatattttctttatccactcattggttgatgggcacttaggttggttccatgtctttgaaattgtgaattgtgctgtaataaatataggcatgcaggtgtccttttgatgtaaggacttcttttcctttgggtagatagtagtgggattgctggatcaaatggtagatccacttttagttctttagagaatctccatactgtatttcatagaggttgtactaatttaccttcacaccagcagtgtataggcgtttcttttcaccacacccatgtcaacatctattgtttttcgtcttttatttctatcaagtattttacatatgatacttggtttagttcgaaattggcctcatccaaaccaaagattatggtgcacttgaaaaatacaaactgaatgttgtctatactcatgagagtttcctgccatggcctaagtgaaatcttgataacactgaacaaaggcttcacttgtcctcatcctttaattctgtattctgataggagacaagatccaaactgagatggagactgtttcagaagcaggaacacatcaagagtggtccttccagcaaatctgggaaaaaattgcaagtgatttaaccaggtctcaagacttggtgataaatagctctcagttctccaaagaaggtgatttcccctgccagactgaggcaaggactatctgtaattcacacaagacagaaatcttcccaagggcaattggatataaaccatccttcagtgatgtctccctctttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcacaaattacacacaggagagaaaccttataattgtgaggaatgcgggaaggccttcattcacgactcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagagaagccatataattgtaaagagtgtgggaagagcttcagatgggcctcgtgtcttttgaaacatcagcgagtccacagtggagaaaaaccaattcaatgtgaagaatgtgggaaaggattttacacaatttcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggccacaatagtaagtttaatcttgatatgcaccagaaggtccacacaggagagagaccatacaattgtaaggaatgtgggaagagttttggctgggcctcgtgtcttttgaaacatcagagactgcacagtggggaaaaacctttcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctgaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaaaaaaaa

SEQ ID NO: 13581 - DNA, 462 bp, Homo sapiens
taggtgggccacagaatggaaagatgagaaacttcaagctgtggcaaaccttggagaacagtgagtctcctgagcgaggggcaggcttggccacatggaatctccaccaagctggccttgcttgggacccaggcttctgaccttcctgcaggtcatttcctctcatcattggagggaaaaaacatcacatctcggagccactttggaaacaggtttattttagtttcagaccaataataaaatatcctgtagagattcccttctcagaaaagtgctgtttgccctcagggaggttgtagtcaaactgggagtgcagtgagatgaatccaagtgaggagatgtgtggtattacagcgcagccagcgaggataaagcagcgctcacctgccatgatcctggctagttttcactctcagtgctgttgtgcattttgcctggtggcagatatcaacactaaaaaaa

SEQ ID NO: 13582 - DNA, 883 bp, Homo sapiens
ttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggagattgcggggaaatggctgcaagcaactgacctcactagagaagtgtaccagcatttagcccactatgtacccaaaatctactgcaggggtcccaacccttttccacagaaagaagacatgctggcacagcatgttttgttgggaccaatggaatggtacctttgtggtgaagatcctgcatttggatttccaaaacttgagcaagcaaacaaaccttctcatctttgtggtcgtgtttttaaagtaggagagcctacatattcttgcagagactgtgcagttgatccaacttgtgttttgtgcatggagtgctttttgggaagtattcacagagatcatcgatataggatgacaacatcaggaggtggaggtttctgtgactgtggtgatactgaagcctggaaagagggtccttactgtcaaaaacatgaacttaacacctctgaaattgaggaagaagaggatcctcttgttcatttatcagaagatgtgatagcaagaacttataacatttttgctattacgtttcggtatgcagtagaaatattaacctggg

SEQ ID NO: 13583 - DNA, 156 bp, Homo sapiens
ccagtttatgtaaataacaatttgcttacatgttcacatagtaattgcattagataatactggcagaggagctgacatggcaggagtttaatgataattttttccagcttttagctgtctttgtcacttgattgtccgcatataacaaggaatatg

SEQ ID NO: 13584 - DNA, 386 bp, Homo sapiens
gtcattcatgagttgagactgccctgaactgaggttctttgtgtctctgtgttaaatcggaatgtttaacaagtaggagtttggaagactccattcctggtgacagtcaggtatgggaccagtcctttataacgtttagtaatgactgccagttgactttgtaaagtgctgtgtcctcataacgttgcttacttccttaatttctctgtgatgagaaagagccttatcttcctttgtaagtgtgcagcagggaagggcccatctttggagtctggaaaggcactggtttaagtttagacggaaacgttatttcacagtccaatggaataataaggtttaaatgcaatgtctcccaaaacgttacttgccctagatgaatcaaagaa

SEQ ID NO: 13585 - DNA, 373 bp, Homo sapiens
caatgttaattcaattaatgactgtactgaaagtttgtcttagtgtgcagtgaaaacaggagagcagcctctaataatctatggatttaatgactgcaactttgaagagtgttaagctaaagtgaagttcagaatggcttgttaactgggtttattagctgttgaccttccctttcagcataatagtggcagtcagaccgaagagagcactaacgtcctgattagcatttatctaaagataggctgctgcctgttacacagtaaattagttcaatcagccataaagagcttgagaaacattttctgctttataaaaagaattagatgttagaacagttcatctggcatagctcagtgaagatggattgagccc

SEQ ID NO: 13586 - DNA, 529 bp, Homo sapiens
gctctcaaaaggggtaataatatttcaaaacatctggaacacggtttgagccattaggccgcacagccccaagtttttattaatttgtactccagacttcactagaggaaaaagcagcacgatttttaggcgaaggaataagccacttgaggtccgcctctgaatcagtttcacaaagaaaagtccatcagtgcagaggaaggccagcggacctgagtacctatgtcgtggttaaagaaggatgactgggccgggcgcggtggctcacgccagtaatcccagcactttgggaggccaagatgggcggatcacgacaaaccatcctgactaacacggtgaaaccctttctctactaaaaatacaaaaaattagccaggcgtggtggcgtgcgcctgtagtcccagctactcggaaggctgaggcaggagaatggcatgaacctgggaggcggagcttgcagtgagacaacatcgcgccactgcactccagcctgggcgacaaagcgagactccgtctcaaaaaaaaaaaa

SEQ ID NO: 13587 - DNA, 486 bp, Homo sapiens
ctatttgtcttctttattataagaataatatgttcccagagtcctgaaaggcaagaagtatgagtgaacaagcggggagtcagagaaggtgagaaaggaaaacatacactgtctgagaacgtcagatgtgatgggagagcagtggggggaagatagattgcaagccttaggatggattgataagtcttagaaaagacagatcattaattaattaatcagtcaattaactaaaaacatactgatgactagctggataatgagaacatgtaattgacttaaacatgttttcaactgagtgaggtagacatagacattgcaacagcggtgctatgctagaggagagaccaaggtgtggtgctggcagtagagacatagaggaaggacctctaacctaccttaagggctcagagaaggcttcctagaagagaccatattaagtgcacatgtaccctaaaacttaaagtataataataaaaataaataaat

SEQ ID NO: 13588 - DNA, 532 bp, Homo sapiens
aaagggaatcagcgctgactgagctcctactatgtgcccttcctgggcctggcactggaatcacaggatgaatgaataaggcatatttcctgccctgaggaggcgtctataggggaagtcggaattaaggcacctccagaattctgaggtcaagggaatgtcaacagagctgtgaacaaaatgcccaaagccatgaaaatctacagagagagactcgaaggggaggaatggggccaggctgaggtcgggatggtggaggaggtggtggaggtgatgaggtaccagagcaacctcgaagaaagctgagaggcaggagaccgccaaaggcaaacttggaacacctggtgactccgactaactctccatgtggtgtccttgaggacttttatgatactgctaccactgctaatagtaataaaagccactatttaatgtgtttactatgcgctgggtgtgcaaatattgtggaaagagtgaacatatgtgcagaatgcttaataaacgtgatctccttttatcttcaaaagaacaa

SEQ ID NO: 13589 - DNA, 786 bp, Homo sapiens
aaagggaatcagcgctgactgagctcctactatgtgcccttcctgggcctggcactggaatcacaggatgaatgaataaggcatatttcctgccctgaggaggcgtctataggggaagtcggaattaaggcacctccagaattctgaggtcaagggaatgtcaacagagctgtgaacaaaatgcccaaagccatgaaaatctacagagagagactcgaaggggaggaatggggtaggagctggtgccgaggatgagaggggagaattcacctggtggagaactgataggtgggggctgttttcaaagtattttcacaaacgtttattctcttgactctcacaataaacgaagccagccagaaagtattctccccatttcagtgataaggaaatggaggctcagaagggtggaatggcccagggcagggcaaagctggggtggaagcatcggtcttgtgcttccacactcattgcactttcttccaggccaggctgaggtcgggatggtggaggaggtggtggaggtgatgaggtaccagagcaacctcgaagaaagctgagaggcaggagaccgccaaaggcaaacttggaacacctggtgactccgactaactctccatgtggtgtccttgaggacttttatgatactgctaccactgctaatagtaataaaagccactatttaatgtgtttactatgcgctgggtgtgcaaatattgtggaaagagtgaacatatgtgcagaatgcttaataaacgtgatctccttttatcttcaaaagaacaa

SEQ ID NO: 13590 - DNA, 588 bp, Homo sapiens
aaagggaatcagcgctgactgagctcctactatgtgcccttcctgggcctggcactggaatcacaggatgaatgaataaggcatatttcctgccctgaggaggcgtctataggggaagtcggaattaaggcacctccagaattctgaggtcaagggaatgtcaacagagctgtgaacaaaatgcccaaagccatgaaaatctacagagagagactcgaaggggaggaatggggtaggagctggtgccgaggatgagaggggagaattcacctggtggagaactgataggccaggctgaggtcgggatggtggaggaggtggtggaggtgatgaggtaccagagcaacctcgaagaaagctgagaggcaggagaccgccaaaggcaaacttggaacacctggtgactccgactaactctccatgtggtgtccttgaggacttttatgatactgctaccactgctaatagtaataaaagccactatttaatgtgtttactatgcgctgggtgtgcaaatattgtggaaagagtgaacatatgtgcagaatgcttaataaacgtgatctccttttatcttcaaaagaacaa

SEQ ID NO: 13591 - DNA, 1029 bp, Homo sapiens
ggcttaggttatcctcccacctcagcctcccaagttgctgctgggactacaggtgtacgccatcacacctgtctaattttttgtaattttaattgagacaggggttcgccatgttgtccaggctgatcttgaactcctgggttcgagcgatctgcccgccttggcctcccaaagtgctgggattacaggcatgaaccacctaacctggctaggatcgcactttgagacttttctcttttttcttttttttcaaaggaagcaaatcagaaatgagatggagtatcatgattagcatctcagagctaatttaaggaaaattgggagagggtgtttgatcatgtcagatctaatctctttcagtaaagtctctttcctcccccataccttcattgtctagagccaagagttggttggatataatgttggctctttttaatccaagttgccatcgctaaaagtagcatcatgacacctgtctggtgctttcaagtctcaagtaaatttctggcagtttgaaaatgatgttaaaaagcacttgggttttaaaaaaaggcacttgaaggagatggtttattctcctcctgtacacacatatgtacataccttgtcaaatgttacttctcttccttattctccctgtgctagaaacgttctccaggtaattgctttttgaaaccgaggttgagcattgcccagcctaaatatgaatatctctaccagtagggaatgaatacttcttgatagccagttttaaaagtaagttgttaatagaaaatactgagcatggcataattctttgtctagagccaggaggacataactctgtgttattctagttgaaacttttcctctaacctaacagtgatcaacagccttctatcctagtgttcagcttacagtttatctgtcttgtgtgcaaagatatcccatataaggtcatccgatcacttgtaaatgtttgcgaaagtattgtgtagaatcctagtcttagatgtgatttatagtaaattaggcattagaccagggaaa

SEQ ID NO: 13592 - DNA, 414 bp, Homo sapiens
ctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagcaaaaaagaaatcaccccttcttccttctgcctttactttctagtagaagttata

SEQ ID NO: 13593 - DNA, 445 bp, Homo sapiens
ccttatgtcttcaccatctttgtaattccagtagagcgcctagcctgtattaaatcagtgattttcaactctggctgcacattagaatcaactggagagtttataaacaaaatgaacgcacaggctcctcttgtgggtgaggcctggagtgtctgtaattcctttttgttgttgttgttgttgttgttttaaagcttcccaggtgatctgaatgtgcaactaggattgagtctcactgtatcactgtattaggggctcaataaatgttgactaaaggatgaggagtggagacagtaagtacaaattattcttgaaaaaaattggtagtgaaacaaaagagaaaaatatgtattactactttgttttttcctgctatttcattttaagaatactttttttttgtaagagaacattctagggtgtataagggaaatgattcagaagg

SEQ ID NO: 13594 - DNA, 689 bp, Homo sapiens
accaacattatgtattgagcatcgtatctttcctactgagcctagacacagcctcagaacctctcaacatagcacttggagcaacaattgccgcttgattggaattgccatttgagcttgagttagccccaatggcagaacgacaggctcgcactagtgtccacctgtggctgtcaggggcggtaccacagaaaggggaaaggccacttgcctctacccactgcccttttggacaacaattccaattgaaggaacaccaatcactgatggatcccattccaaaatgtctcttcattcacatcatttaattctgttgaatgaatatgttcctccctcaccttttataaacagaaaattaatataagtcccagttacttgcttcttagactctgtgagactcatgtaccaaaacaatgtgacattcttttcgagactttgacttgtacggtcagtatgaatttagtgcctttccaggcagcaaaatgtttcttctttgctgatttcataggacaaatatcctagcatactcacaccaccagtgtcccaccctcacagactggcacattagaatcatattaatctgcttgtttgcatgttacaactgatactgcaaaagcctattcaagtcggactgaactaggctaagcagaggacccttgtggaacctggagcatttctcagggacaggt

SEQ ID NO: 13595 - DNA, 202 bp, Homo sapiens
cggcgcccaggctctttagctcggccaaagacccctcctccactcattttttccttcattcattctctcattcactctcgagtattttctgaaccagactgtgcgctgagggtacggtagggaacaacacagagtcccccgccctcgcttcctcctgactgagataaaagacaaaatgtgaataaagggttataatatggat

SEQ ID NO: 13596 - DNA, 784 bp, Homo sapiens
cattggtgacggtgctaggttgtaggatatgcactttgagtccaaggaggcaatgttttatccatttcatcctccataggagctagcaccaatatgaacacataatatgtatcaaataaattacctcatggaaatcagaagagacctcagttttctctaacaatctagatttcttcacaagtggctcttcaaatatgttaaaaagtgtattctgttctcaataatttagtattaaggaaaatgtacctaatatgtgtacttgaactatttctgtggtatgtgatagaaaatccatcttaaattattataagaaataaaagcacaatttattaacaaaggaattggagaatctgagagcatattggatttaggtttgggttgatctgggagctcagatgaaggcatagagaccaggtgtcttactccatcttcctacatccctgctctaaagaggctctgctctctgccaggcttatctgttgcagctaggcctcacaagaccccaggttcaaatccagcaggaaaaaaagtctctagtaactcttgcacaacccccaggactcacttggactagcggagcttgggacagatgcttatcccttaacagttcctgaagagtattctactgccagaggaaaggaggagtggacgccaggtggcctgtatgcagtaagagtccactccatctatggaccccttggttaccttttccaggcctttgtagctcactcctcctcaggtaaaatttagagaagtgatattatttttaataagatcacgagag

SEQ ID NO: 13597 - DNA, 519 bp, Homo sapiens
cctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttgttttgtttttaaagctgttttttaatacattaaatggtgctgagtaaaggaaata

SEQ ID NO: 13598 - DNA, 457 bp, Homo sapiens
tacagtagcctgcagattagggtttccctacatggccagtcattgcagtcaggtagggcacttattcaaaatgagatactagggccccaccacaaacctacccaatcaggatctgtactttaaagaagctccctgtgagattctgggaaacactactgaagatgtaggaagagagtgaggaagcagggcccctggccagaggttgctgcagtcacccagggccagcagatgtgtatgcccagaggggtggaatggcaaggttttgggacagcctcttggtataaagtgaaagagcggagagaaagaaaatgagatcatcatttatgatcacggtcatggggaacaagagcccaggtcagtcctggtgagcaggtggccccagtgaggtcttctccactttcccctctgtaacttgaccttggacttcttctggtatcaaattccagttattaccccc

SEQ ID NO: 13599 - DNA, 582 bp, Homo sapiens
aatatgattttctatgtgtgccatgcagatcaggagcactgtagcaggcccctctctctatcaccagtgcatcactttcatcatggagcaggttgggaaacaagccaaaggctggccccacagacacaaagaataagtcacaactcacccacgtggtgtgtttcctcctaactctttagtttgaaattttcaaacttgacagaaaagttaagaaccttcgtccagattcactcattgttgccattttgccacgttttctttatctcactctctttcacgtggttttgctgagtcatttgaaagtgagttgcagacagcccaccgttaagtacgtcagcaggtatctttcaggagtgtggacttccccatttgcaaccacggtgccatcatcacacctaagaaattaccactgtccaataatatccaatctacaacccattcatatttccccagttgaactccaaaaatgttttcgtatggctgttttcctgatccaaaaatcttcatgcattacatttgggtgttgcgtttctttaccttcttttaatctagaacagcctccctgctctgtgtgtgtgtgtg

SEQ ID NO: 13600 - DNA, 255 bp, Homo sapiens
cctgtccagccacccagaaaaagcaatggctttggtaacatgacatgttatgtataaaatgcttcctgccaggtgaggtggctcacgcctataatcccatcactttgggaggccagagggggtggatcacttgaggctggcttgaactcctgacctcaggtgatccacccgcctcagccttccaaagtgctgggattacaggcgagagccaccgtgcccggcgcctgtgcctctttgtattttccatgctaaccg

SEQ ID NO: 13601 - DNA, 762 bp, Homo sapiens
gcaaccacggtgccatcatcacacctaagaaattaccactgtccaataatatccaatctacaacccattcatatttccccagttgaactccaaaaatgttttcgtatggctgttttcctgatccaaaaatcttcatgcattacatttgggtgttgcgtttctttaccttcttttaatctagaacagcctccctgctctgtgtgtgtgtgtgtgtgtgtgtgtgtgtgtgtgagacattggctttgaagagtccaggaaggccagctgtgttacacaatagatttgtgtaatcgaatatgttcaggttaagtttgcatagtttcaaaactcacctgataattgcttcattgtgtccaggaaagtcctaaggcagagaggctatctctttggctgtctgtccctgtgtgtgttgtggggcatcctgtccagccacccagaaaaagcaatggctttggtaacatgacatgttatgtataaaatgcttcctgccaggtgaggtggctcacgcctataatcccatcactttgggaggccagagggggtggatcacttgaggccagaagttcaagaccagcctggccaacatagtgaaccccatctctactaaaaatacaaaaattagccaggcgtggtggcaggcgcctgtaaccccagctactcgggaggctgaggcaggagaatcgcttgaacccaggaggtggaggttgcagtgagctgagattgtgcactgcctccagcctggatgcagacgagactgtctca

SEQ ID NO: 13602 - DNA, 532 bp, Homo sapiens
gtgcatataagtaagaaagtcttaagtgtttagctagctcaatgaagcttgtggcccaaaattacctgagacaggtctcaaccaacttagaaagtttattttgccaaggttaacagcctcaggaggtcctgacgacatgtgtccatgatggtccgggtacggcttgcttttatacattttagggagacataatacatcaatcaatacatgtaagatttacattggtttgatctggaaggagggtacaatttcaactgggatggggggcacttcttggtcataggtagatttaaaatgtttctacctggcaattggttgaaagagttactatcaatagaaaggaatgtgtgggttatactaaggggttgtgaaggccaaggctttatcatgcagctgaagcctccaagtagcaggcttcagagagaagagtttgtaaatgtttcttgtcagacctaaggtctgtgttgatgataatgctggagggtagatgaggcaggtccgatcctctcttccatcgtgtcctgaactcgtt

SEQ ID NO: 13603 - DNA, 356 bp, Homo sapiens
tgttcagatttatttgtagttctgcctccccttcctctccacacacacacaaacacaactataccatattcttctgacccttgcttatgcctctgcctttgcctgggctgccctgtggctaatccccctcattctttttattaactaaattactcctcatggttcaagtccaaattcagatgccactttttcaggaaccaagactgaattgtgtatcttcctgtgtgttcatatagtttctgtcaaagcacttacccacacgtattttcatgttcagctcctcatctagattgtgtgtgtagtgtgggtgagaatgtcttattcatttatattcctggtgactaatatactacctg

SEQ ID NO: 13604 - DNA, 442 bp, Homo sapiens
tgacaaccaaaattgtatccagatattgccaaatgcccgctgaggggcaaaattggccccagctgagaaccattgaatggatttttagtaaatcctgatgttaatgtaaattctccatttttgttgttttcccaagattttagatcttttgtgtttcaattatgaattttagaataggcttgctaattactataaaaaggagtatgattatgctgagactgtaattggggttgggttgaatttgtagatcactttggagacattttaacagttttgaaagttctagtcatgaacatggcacatctctccatttatttaggtcatctttaattttcctcagcaacattttgtagttttggtagaggtcttgtatatcctttgttaaatttattactaaggattttatgttgtatgatgcaaaaataaatggaattgtttttta

SEQ ID NO: 13605 - DNA, 3121 bp, Homo sapiens
  misc_feature (2977)..(2978): n is a, c, g, or t
  misc_feature (2982)..(2982): n is a, c, g, or t
  misc_feature (2988)..(2988): n is a, c, g, or t
  misc_feature (2990)..(2990): n is a, c, g, or t
  misc_feature (3002)..(3002): n is a, c, g, or t
  misc_feature (3007)..(3007): n is a, c, g, or t
  misc_feature (3009)..(3009): n is a, c, g, or t
  misc_feature (3012)..(3012): n is a, c, g, or t
gcggggcctccgtatccccacgtgggccctgcaggaactggcggggcgcgtgacccggcgaggcccagagacaggggaggggcgccgggagccgggcggatccgcgtccccgatgcgcgctgcatttccggcgggcggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctctaaaaaaaaaaacaaaaagaacaaaaannaaanaaagananaaaaaaagaaanacaananaanacaaagaaaaagagcacaagagcgaagaaaggaacgaagagaaaagagacgggagaagagggggggggggggggggggcggaggcgcggggggggcgcggggggcgagc

SEQ ID NO: 13606 - DNA, 381 bp, Homo sapiens
gtctgacccagtgccctctaggccaaaagccccccccccccaaaacccttttttttccttttaaaaggggggcccccttgcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctcta

SEQ ID NO: 13607 - DNA, 1663 bp, Homo sapiens
gcggggcctccgtatccccacgtgggccctgcaggaactggcggggcgcgtgacccggcgaggcccagagacaggggaggggcgccgggagccgggcggatccgcgtccccgatgcgcgctgcatttccggcgggcggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcagtgagcagacggctggggctggggtgggctgagggtgggctggaggtctccttgcccccgttggtggtgaattggtgactcacccaacagagacagagggcgggctcaggggagctgatctcccatcttggtgagtgtgggagggtagggaggtggacctgacccctgatctgcccatccccagaccgccctggtggtgcaggctgtgaagaaagaccaggagggggattcagcagctgccttatcactctactgcaaggctctggacttctttgtacctgcccttctgcccttaaatgcttccttgggcaagagctgtctgtcctccctgcaggaggctgagtgtgaagagtatcattcattgtttctctattaaattattttctcta

SEQ ID NO: 13608 - DNA, 2951 bp, Homo sapiens
gcggggcctccgtatccccacgtgggccctgcaggaactggcggggcgcgtgacccggcgaggcccagagacaggggaggggcgccgggagccgggcggatccgcgtccccgatgcgcgctgcatttccggcgggcggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctcta

SEQ ID NO: 13609 - DNA, 1310 bp, Homo sapiens
cccacgcgtccgcccacgtgtccgcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctcta

SEQ ID NO: 13610 - DNA, 1204 bp, Homo sapiens
agtgactctacagatgcttatctgaggaggagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcactcagccccacagaacccaccagtctttctgggaactcacacctgcccgccatcttggtactttaggttaatccctcaagcatgaaagctggatcttttggggtttaagaagcccaagccttgttcctgccctggcctagggagcactcaggagggttccttggtcctcatctctcccacctccgttccctctgggccccacactagccacagcgcgggccttgtgctggagtttgagcctgggacagggagagggaggcttggagacagtctgacccagtgccctctaggccacccacttctaggcctgccctgccgccgtggagccctgggcaagctctttcccctttctgggcctgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctcta

SEQ ID NO: 13611 - DNA, 2561 bp, Homo sapiens
gcggggcctccgtatccccacgtgggccctgcaggaactggcggggcgcgtgacccggcgaggcccagagacaggggaggggcgccgggagccgggcggatccgcgtccccgatgcgcgctgcatttccggcgggcggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgagacccccatatcccagagtccccagcctccctcaggttactctgcaccccacagatggtttgatggctgtgctgtatactggaggggagggcaggactctgggagaacagcacttctttcatgagacctttgttactcggtggttactgggtcctgtgcctgtccgttttggggcatgcagccctctatcatttttggctccgagaagagggcaaggggcccccgcagggtacttctgtgcttgccctcgccctgccagcaggcagctgtgcccctggcctgcccttcccgggaccccttattccaactcagctcctctttgcactggaatggggcactccaacacccctcagggaccaccctccccacagtatgcacttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctcta

SEQ ID NO: 13612 - DNA, 2218 bp, Homo sapiens
gcggggcctccgtatccccacgtgggccctgcaggaactggcggggcgcgtgacccggcgaggcccagagacaggggaggggcgccgggagccgggcggatccgcgtccccgatgcgcgctgcatttccggcgggcggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgccaagaaggacactcgtgaagtggtagccataaagtgtgtagccaagaaaagtctgaacaaggcatcggtggagaacctcctcacggagattgagatcctcaagggcattcgacatccccacattgtgcagctgaaagactttcagtgggacagtgacaatatctacctcatcatggagttttgcgcagggggcgacctgtctcgcttcatccatacccgcaggattctgcctgagaaggtggcgcgtgtcttcatgcagcaattagctagcgccctgcaattcctgcatgaacggaatatctctcacctggatctgaagccacagaacattctactgagctccttggagaagccccacctaaaactggcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgagctccccttgcggcccctgctctcccgagactgccgggacctactgcagcggctcctggagcgggaccccagccgtcgcatctccttccaggacttttttgcgcacccctgggtggacctggagcacatgcccagtggggagagtctggggcgagcaaccgccctggtggtgcaggctgtgaagaaagaccaggagggggattcagcagctgccttatcactctactgcaaggctctggacttctttgtacctgccctgcactatgaagtggatgcccagcggaaggaggcaattaaggcaaaggtggggcagtacgtgtcccgggctgaggagctcaaggccatcgtctcctcttccaatcaggccctgctgaggcaggggacctctgcccgagacctgctcagagagatggcccgggacaagccacgcctcctagctgccctggaagtggcttcagctgccatggccaaggaggaggccgccggcggggagcaggatgccctggacctgtaccagcacagcctgggggagctactgctgttgctggcagcggagcccccgggccggaggcgggagctgcttcacactgaggttcagaacctcatggcccgagctgaatacttgaaggagcaggtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttcttggatggacagtgctgactgggtctccccatctcttcaatggggctgataccttcacagcccacagcatgggcacttatgaggacaaagtgaatttaacctggaaaagaatgtatttgagagtttcttttaaataatcagcgggtgttggtgatttgtagcccttctgcccttaaatgcttccttgggcaagagctgtctgtcctccctgcaggaggctgagtgtgaagagtatcattcattgtttctctattaaattattttctcta

SEQ ID NO: 13613 - DNA, 502 bp, Homo sapiens
gccgcaccgcgctgcccattccctgccagaccttccccgcctgccaccgcaatggaggtgacgcggcctgcacacacctgtgcacagcggggctggctgggggatctcccggggtctagctgcacctgtcctgacttcctctcacctgttcacgtctgtgcccagggccctaaatcctcataccacatctccacccctttttcccttctgatgaggcaggggcagcctggaccattcaagggcaggggactgggaactaggggaggggtacctgaggcccctgcactcctcactcctccttcttccacctcagacttcacgggaggctaccgcctggggcgctccgcctccacctccggagtccggcaggtcgtgctccacacaccccggccctgcagccagcccagggatgccctgagccaggtgaggcttggtttttcttttatttgtgaaggagcaggtggagaaggcttgaatatgcaaagaaaagcaataaaggggc

SEQ ID NO: 13614 - DNA, 298 bp, Homo sapiens
ttagtgaattgtactcattcgtgttcattggctggaagttagtgaattaatgggaaaatgttaggatttatggctcactcttttgaaaaatgagtgtcatgtgaggggaagaatattaacccaggaatcaggaaaattagattcaaggtctgtctccaccatgggactctgggcatgccagttaattgctttcagtctaattacctataaagtgaagtagatggacttttaatgtgcatttgaatgaggacaaatggagtttcatggagtttcaagtagaatggaagctaaaacgttt

SEQ ID NO: 13615 - DNA, 435 bp, Homo sapiens
gagtataaaaaaaaagtccacacctagtcatattatgttcaaatcacagaaaactaaagacaaccagaaaacatgaaagaagctacagaagagaagaaatttacctaaggagggacaaggataagaattacatcagaaatctcattggcaaccatgcaagaaagaagaaggtagcgtgaaatatttaaagtgtttaaaggataaaactagaattctggatacagtgaaactatccttcaaaagcaaagaagaaatgctttctcagacaaaggctgaatctgtcaccagtagacctgccttgaaataaatgttgaaagaaatttttcggtcagaaatgaaatgacataggtcaaaaactgaaatctacgtaaagaaaagaagagctttcaagaaggaataaatgagcataaaataaactctttaatattccttaac

SEQ ID NO: 13616 - DNA, 386 bp, Homo sapiens
agagacggggtttcgccatgttgcccaggctggtcttgaactcctgagctcaagtgatccgcctgccttagcctctcaaagtgctgggattacaggcatgtgctactgtgcctggccagactttttataagcttagattatgagggtagtagtagtatgtccagcaggtatttttgacatatgtgctaggcactagattttctttttttttttttggttcaataacacaagtatgtattgaacacctactatttcctgacacagttaatattaggcattatcttgttgaacattagttaaaacaccatttttttttctcttgagatggagtctcgctctgtcgccgaggctggagtgcaacggtgtaatctcggctcactgcaacc

SEQ ID NO: 13617 - DNA, 553 bp, Homo sapiens
ctgagaatggcatccagacatggccttcaaggctctgtctgcctcggtgaccccatctccagccactgttcccagttcacatcggggaattctccggccctcctagagaggcagcccaggttgctaaagaggcacttcaagcacatttcaaagaacgcaagaattctggagaggtggagagcaggagaatagcacaagcaagagccagctccagggtcaggctggagatgggaggtcaggcatggtggggaggacgggaagtggggctgggttcaaagcctggctcagcttggaggacctggcaggggctcggggtgggggtggagtgtctcaatcctggtgcacactggagttattcgaagggcttttaaaaattatcaaagttgttccaggttcattccccgggtggcccacacgctgtttttaagtttagctctccaacccttcttcctggttctccccttcccttggaagaaagtccctggtccagcctgggtgttggcactggcatttgccctcccagggccactgggactgggaatccccaggaggg

SEQ ID NO: 13618 - DNA, 621 bp, Homo sapiens
actgaggacaggaaagagttcagttaagaaatccctaaggttctgtcaagacaattacttcactagatatgaagacgatagcaataactggattaggaatttagcaatatttagaatctaagagtaactatatggtgaacaataatcacataatttcgaatgaacaatccataaagttgtttccaattccgtatgaatttatgttgccaagcaatgtatttaaattcacagatcaataaaatcaataaagcagaattcttacatcaataaaacagaattcttacctcactactcagattttcctaaaatcacattacaaaattcgtaaccgtatttaagctatttttaaaactgttacataaacgcagtactgtaacaagccgcctttacgtacaaaacagtaaataaaatcaattttaatgtaaagaatattaacgcttccagaaaaagcattaataccacactgtagtaagagttttcctaataagataggcactttttagtcctacaaagttgggtaacagaaactccgccctgtgagaacgcttcctgaagattaaggcgcctctgggtgagacacggaagctagttctcctcccgccccgaaaagaaaaaaaaaaa

SEQ ID NO: 13619 - DNA, 314 bp, Homo sapiens
gatcagcctgggcaacatagtgagaccccatgtatacacaaagagaaaaaaaaaattctcctgcttgtagcttaggctattcatttttagaagcagtttacttaagcagccaatgcatcctagttctcttaaattaacactttagtttttcatttttttgagacagtctctcgctctgttgccaggctggaatgtggtggcgcagtcttggctcactgcaacctctacctccctggttcaagcgattctcctgcctcagcctcccgagtagctgggactacaggcgtgcgccaccatgcccagctagtttttgt

SEQ ID NO: 13620 - DNA, 571 bp, Homo sapiens
ccagaggatatttggtgatatctggaagatctggagatattttttcattgacatcctagggggatagtaagggcattcagcaggtagaggccaagggtgctactaaatgtcctacaatgtacagggcagcctcccacaacaaatctagctaaatgtcggtagtactgaggttgagaaaccctgtgctctagctggaagcctggtgtcctggctggttttaccctgaaggagtcccagtgtgatgactgcttgggagtggactttggtgaaggtggtgagagatacttgagcatgggagtggagagaaggtttggagggcaaacctccaaggatttcatgatccttgaaggacaaatattatcccaagttagttcaagggaagatcacacagagcttctggttaatagcagtggctgagctctgaaggcaccccttttcctcgaccaggaagctcctagggtaatgtagtggaccaggcatttcctaccctcctcccaactcccctgtaaacgtgtacactgatggccgggcacatctgtaatcctgtgtagctcacacctgtaatcccagc

SEQ ID NO: 13621 - DNA, 263 bp, Homo sapiens
caaatcaattgttgaaaatatttatttagaaaaaaatatttagttggaaaacagaagaaaccaaagaaaaacacacttcatgcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagca

SEQ ID NO: 13622 - DNA, 871 bp, Homo sapiens
cgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggtatagtaagggctaatcaaaactttttttagttaaataagctgttgtgctgtgagtggaatagaaacttgtttaccatgaatgatatgaatattatggatccctgcatgctgtttttgagtttcctgtactgacagtgcacatagacatgtgttttattttcacagagtagtttcctgaggtgccccaagtcttgtgcatctatatacccgtatgacgtgccaattaacgttttaaacaaaccttttccaaacatgaaattatgatatgtctttacattttcttttaaagggatgcctggcttggtgtggtgtggctcatgcctataatcccagcactttgggaagccgaggtgggcagatcacctgaggtcaggagttcaagaccagcctggccaacatggtgaaaccccatctctactgaaaatacaaaacattagccgggtgtggtggcgggtgcctgtaatcccagctactcaggaggctgaggcaggagaattgcttgaaggcagcagtgagccaaggctgcagtgagccaagatcacaccactgcactccagcctggg

SEQ ID NO: 13623 - DNA, 5079 bp, Homo sapiens
cgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacatacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtgttcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactctggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagcaagttatgttatttttcttttatgcatttattactaacatagctttaaatctttaaatgtattgaagcattgtgctgtctgaaaataaggaattgcttataaaccagccacttctgaatacaatatgtagctgatttaataagctagttagtgaatggaaaataagtgtggagtattaaaaatgttctttggttggtaaggcctaagatagggtttcatttatttctatactttttctgttttttaaacacctgcatatttttatgtaaatctctaaatttaaaatattttaagtacatttatttttggtgttttattgtataaaaccttagacaatcaatcagtcagtctttactgacaggagcagcagctatctgtcttttgctgatctacaaataaatgaattgagaatttagtccatagaggtccctggctaccaaacacattctcctttgaattgttaaaattcagaacattcaaaataactgttttgctacaacccatgattattttcctgttgtgtttatttaaatttactttctctttagaagtgcacttatttctgaaaaatcttaatgaaacaaacgcttagaacaaatataaatatgagacacttgggactactagagatattttagatttttatgaaaaaaatgtgaggggatattgctgctttaaaaaggaataaagtaataaaaatatatctcagctatttttttaaagcaatataattcagcaattgtctagaaaagtaatcatgaggctactgagtttggtgttcagttactgagtttcaaaaatgttttggtggcatgaggacaaaatttcattgaaggtaagataagaataaaaactatgtttacaaaaaaactg

SEQ ID NO: 13624 - DNA, 4207 bp, Homo sapiens
cgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacatacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtgttcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactctggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagca

SEQ ID NO: 13625 - DNA, 4125 bp, Homo sapiens
tgtgtatatgcggggaaacgccatatcgggggcaccgattattaggggaactaggcagggactacaacaacctttcctatgagcaaccatacccgggaaagagtgactgtagccaagctcacattggagaatttttatagcaacctaattttacagcatgaagagagagaaaccagaggagaaaactggaaatcattcaacaagcagcactgaagtgcctaggggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacatacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtgttcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactctggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagca

SEQ ID NO: 13626 - DNA, 4154 bp, Homo sapiens
cgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacatacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtgttcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactctggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagca

SEQ ID NO: 13627 - DNA, 4153 bp, Homo sapiens
cgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacatacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtgttcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactctggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgatatgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagca

SEQ ID NO: 13628 - DNA, 3687 bp, Homo sapiens
  misc_feature (3637)..(3637): n is a, c, g, or t
cgcgagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacatacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtgttcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactctggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaatgaacctgattnccccctaattaccttttaaaacgcataattttgggggtcccccgcctcct

SEQ ID NO: 13629 - DNA, 660 bp, Homo sapiens
tagatattttttaaatgttaagaatgctggtttgacgagttgctcctttgtaggcatattccacagttgggacaccagattacattgctccagaagtattcatgcagactggttacaacaaattgtgtgactggtggtctttgggagtgattatgtatgaaatgctaataggtatgttttatcattcatttatgtacaaaatatatacatttccttgagtgccattgtttgaacatattacagatatcattgactaaaatatttgaagtcttttaagcttaattctgatgttcccccaatgttaaatacatactgatcaataccagtgagctccccacggatcctgtttcaggaaggtgggtatttaacccaaactcccacgtataaaagtggttatctacatagcttttcaggtaaaaggggaggcagtgctttcaatcctttattttattgactttattagcaatgtgattgtaaattgatgaatggtggcatttttgactgttaaatagagcactcagggttgtttggtttcttgtcgcacatgtttggtgggtataaacttcactgcttacaaagctgatgaaacatttttgatttatttgatacataggatatccacctttctgctctgaaacacctcaagaaacatacagaaaa

SEQ ID NO: 13630 - DNA, 204 bp, Homo sapiens
actttttaaaataatgactgcacctttgttatccaccaacattcaacttaggtttcatttttattgcatcatcaacagatttggtgtttttaaaaaaatttatagtggccattctaatgtgtgtgaggtgattttgtttgtcattgtgtttttttttttcatttctctataaactagtaattttctgtgtcctttcaaatgctt

SEQ ID NO: 13631 - DNA, 762 bp, Homo sapiens
ggccaccctattcacacacacacacctatgtgtgtatagatatttgtatatatgtgtttttatttttaaatgattctgtcagggtctcagatagaggtgaaattctaacctactcagagtgatttcttttaggttcccagacctgggatccacattttttgctctactgaggtaggaaggtgtcactagatccattaagaactgcaaattcaacatctgtgagaatggttgaagctcaaaagactggccagcttctcaaatacccagtgactgaaatacgtaactggccagcttctcaaatagccaaggcagtgccaaggttactactcaggagaatgtcttccatgtgcctggggcagacaggaagtgttctgaccctctgcccacagctttgttcctgtacccaccaactcaagtgattaatggggtggcaggtggtgcagcagccaagtgaccttcacacactgtaactccttttgtttcctatgggacactttccagatggggttttcagcactcaggaaacctctttgtggctggcagtaatgcaagaagtgcagtgtttatccatttcctctcctgaagccctgccctttggagcctcgtccttgtattgctgcccaggtatttcacaaattccagatcattcccacactgttcctgcacacacagcgctatgccctgtcccctgctgtcctcttgcatgtgacaagccacagtgactttatttcctatgtgtctaaccacaaggctcttacagaa

SEQ ID NO: 13632 - DNA, 1195 bp, Homo sapiens
agcttgacatcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcaggtctcaccctgccttcccagccccgatatctggaatgtcgatggcgctaattgccagcatgtgtttgtccttaagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaaaaaaaaaaaacaaaacacaacaacaaaaaacaacacaacaaaacaaaacaaagaagacaaagaaacacaacacaaacaaaaacaaagaaacaaaagacagagagagaaccaacaacacacaacaacaaaagacaaaaagacagagacacagacacagaaaagaagagagagcgacgagagaggacggcgagcgcagctagagcactctccacctgcgcactctccggggagaggagccacgcggcacgcaaggagtccactgcactctacggccgctcagcctctcgttttgtatattgccgattgaggacgcgacgcgctatggctcgcagcacagccacctcccggctc

SEQ ID NO: 13633 - DNA, 1120 bp, Homo sapiens
agcttgacatcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagtcagtcctcctagttcagagcagaacgatgacacccagcagactttttttcctcaaaaggttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaaaaaaaaaaaacaaaacacaacaacaaaaaacaacacaacaaaacaaaacaaagaagacaaagaaacacaacacaaacaaaaacaaagaaacaaaagacagagagagaaccaacaacacacaacaacaaaagacaaaaagacagagacacagacacagaaaagaagagagagcgacgagagaggacggcgagcgcagctagagcactctccacctgcgcactctccggggagaggagccacgcggcacgcaaggagtccactgcactctacggccgctcagcctctcgttttgtatattgccgattgaggacgcgacgcgctatggctcgcagcacagccacctcccggctc

SEQ ID NO: 13634 - DNA, 1060 bp, Homo sapiens
agcttgacatcatagtatatccgtgagtcaagcggctgtgggtttttggctcttgcatctgctatagttctgtctcgggtgccatttgctaactctgttctctgtgtagctgcttttggcagctcctcatctctcttctaatccaccactcacagtcctagagaacagaccacaagttaagaccgtcacctacagaatcccaagggccaaaactgggcagaggacaactccatccttcttacaaaagggcttctccacaagaagcatttccgttagactctagcagtgagataccctgcttcaagaatttctcatggagccagaagcctttgaaatttgcccttatgatcctcaccaccgaatcccactcagcagattccagtaccacctggcatcgtgcaggagaaagaaccccaagaaagccaaaaagatggccacctgcaaatacaacgcctgccacgtggtccccatcaaaaatctggaggaacatgaggctgtttgtgtcaacaggagcgctgtggaagaagaggacaccgagaaccctctgaaagttgtttgtgaaaatgacacgaaagagtcagcaagagagaccagtccccagaagatcctcagaccaggacagtaaactgccagctgaggaaggagcacacgcctcatcaatgcatggaagaacgtgcaatgcatcagaataaaagacatgcaaagtaaaaaaaaaaaaacaaaacacaacaacaaaaaacaacacaacaaaacaaaacaaagaagacaaagaaacacaacacaaacaaaaacaaagaaacaaaagacagagagagaaccaacaacacacaacaacaaaagacaaaaagacagagacacagacacagaaaagaagagagagcgacgagagaggacggcgagcgcagctagagcactctccacctgcgcactctccggggagaggagccacgcggcacgcaaggagtccactgcactctacggccgctcagcctctcgttttgtatattgccgattgaggacgcgacgcgctatggctcgcagcacagccacctcccggctc

SEQ ID NO: 13635 - DNA, 348 bp, Homo sapiens
tcttgccgcttgtccagagcgtaattccagtggcaggaatttcaggttccgtggcaaagggggcctcctcacagcaggcagcagggagaaggaattccgcagaatgggcagggccctgcgtctctcagatttcaaaggaggcgccattgcttttatctgagcaggggcggctgagatgaatgcacagatgccattttagagaagacagtaggccaggcactgtggctgacgcctgtgcctctcccagcactttaggaggccgaggcgggtggctcacctgcggacggatcacctgaggtcaggagttcgagaccaccctgaccaatatggtgaaaacccatctctact

SEQ ID NO: 13636 - DNA, 866 bp, Homo sapiens
tttccatgaagcctattagcaattagagtacatttctgttttcctgtagccccaccaaaactggcattgtcatattaattttccttattttacaagttatttccatattttaaaggaagttgtgcttttttttcctgcatgggaatttgttgtattatatttagctaggttacattgcagtaacaagcaaaccccaagtctcagagacttaaactaacacaaatgtctttctcgcttgatctgtgtgtcccttgtaggatggctgggggtgcggttccacagagtccctcaggccaggctgattaaggagacagcactctctgagagctgccactcgaggcctgctcagtggacaacacagtagacaggagaggctgggggctttgtgtggacttttcactactgatgtggccaggactaccaacacagtctggcttagcaggtagaacttagtgagcattcctgtctctgcccagccatctcctcttctgtttgttcctctccagcaacttctttgtccagtggaattggatcctctgtcttcatatcagctcttaatgtattttaggtaataagatttttatcaattgtgtctttttctttctttgctttccatattgtattgtgcaaaagtttaacgtaagttttggacacattcatgttttcctctgataccttattatcacaaatttcttttctcaaagccagagaataagctgcttttctttgagttgcttaaaatggattttatttggctccttatgacacttgaaattcatcaaaatatataatgtcaggtggttttaatctaagttaattaggtccttggtgatgcctgttctgcaacattaaaacaaaacaaaaga

SEQ ID NO: 13637 - DNA, 618 bp, Homo sapiens
tttactgtcaaatactcaatcttattcattctaattacatttttgtatgcattatttgaagaaatttatccactctgccagtctcccatttttcttatttatttaatcctaatttctcttttaagaccaaatccagatgaaaacttggcgtataatcttatagcagttcccttgtttgttttgaatcacatttcaacccaaaggattccctttagcattccttgcagagtagatctagtaaaaacatactcccttagctggtgttcatctgggaatgtcctcattattgacaggcatgtttgccaggcgtagaattctcagctacagctttttctttcagcactttgaatatatcagtccagtgccttctaacctccaaggtttctgctgatgatcttttttttttttttgagacggagtctcactttgccacccaggctagagtgcagtggcgcgatctcggcccactgcaagctccgcctcccgggtttttgcagtctctattttaatttctagtcatgtgtggtcactgaattctctctctttagcttgtgttcaggtactgttttaacaggcatttttcctggaaggccaggattcaaacaacaaccaccaaaa

SEQ ID NO: 13638 - DNA, 508 bp, Homo sapiens
tttactgtcaaatactcaatcttattcattctaattacatttttgtatgcattatttgaagaaatttatccactctgccagtctcccatttttcttatttatttaatcctaatttctcttttaagaccaaatccagatgaaaacttggcgtataatcttatagcagttcccttgtttgttttgaatcacatttcaacccaaaggattccctttagcattccttgcagagtagatctagtaaaaacatactcccttagctggtgttcatctgggaatgtcctcattattgacaggcatgtttgccaggcgtagaattctcagctacagctttttctttcagcactttgaatatatcagtccagtgccttctaacctccaaggtttctgctgatgatcttttttttttttttgagacggagtctcactttgccacccaggctagagtgcagtgagccgacatcatgccactgcactccagcctgggcaacagagtgagactcttgtctca

SEQ ID NO: 13639 - DNA, 416 bp, Homo sapiens
tcgacattccttttgcatgatggtattttcggagaccagtctagttgggaatatctaaggccctagaaaactacctccaaatttttaattggccttttagataggttatattacacatgtatcaaacataccttgttttaaaagtttaaataaatgctctgcctcccgggctcaagcaattctcctgcctcagcttcacgagtagctgggattactggcatgtgccactaccgccaagctaatttttgtatttttagtagagacgggttttcaccaccttggccaggctggccttgaattcctttcctcaaatgaccacccaccttggcctctcaaagtgctgggattacaggcgtgagccaccacacccagcccagtttctaatagaaaattttctccatattttccagctagtc

SEQ ID NO: 13640 - DNA, 428 bp, Homo sapiens
agatggtctcgatctcttgaccttgtgatctgccccccctcggccctacctagcccaacttttaaggacaagtccagcccatcccttatccctcacagcaaataacaaacatagtgatttgtgggggtgaagagatgttggtcaaggggtatgaaagtacagtcagataaaaggaatgtgtccctagatttgatagaatactagggaaattacagttaacaaaaatttattgtacacttcaaagtagctagaagcaaagaactgtaatgtccccaacacaaagaaaagataaatgtttggggtgataatatctcaattactctgatttgatcattacacattgtatgcaggtatcaaaatatcacatatccccccaaaatatgtacaactgttgtatattaataaaaataaatacaaacaaaaaaaac

SEQ ID NO: 13641 - DNA, 165 bp, Homo sapiens
ttcttcaggcttatttcaaggtattctctttgtctttggttttctggagttttaaggtgatatgctaggtgtagattagttttgtagtttttgggatttattcagtttactgttctctgggctccctgaatctgtggtttggtgtttgtcattaatactggaaag

SEQ ID NO: 13642 - DNA, 560 bp, Homo sapiens
gaaaccatgtagagtatgttgtgtgaccatagaggaattagaaatcaacacagaaataaatttggaggtcacaagatatttggaaattaacacactttacagagcccattggtcaaaaatatatatattaaactagaaaggccgggggtggttgcttacacctgtaattccagcactttgggaggcgtaggtgggcacatcacttgaggccaggagttcaagaccaacctgggcaacatggcaaaaccccatctctacaaaaaaatacaaaaaatgagttgagcatggtggtgcatgcctgtagtcccagctactcaggaggctgaggtaggggaatcacctgagcccagcaggtagaagctgcattgaaccaagattgcaccactgcataccagcctgggcgacaaagtgagaccctgtctaaaaaataaaaggaatccagaaaacatcttgcatagaatttgatacaactaaagacatgcttagagggatatttatagttttaaataactgtatcagaaaaaaagggaagataaataaatgacataagcttccacctt

SEQ ID NO: 13643 - DNA, 446 bp, Homo sapiens
ctaccctgtcaggagttaacttttatgcaagaggattttttttccttttagaagacattttactaggccgggacccaaattcacaagacacccttttctctcccttgttggaggagggctcaattccacagcttcaccttagtatttggcttatgctaaggagtccgtgtaacccctgagacatatttctgtcccaaactcaattccaagcttataaacttgaaggctactgacagcagggggacagggtgtgcataggcaagagtggacaatcccaccacctagacccgttaacatgggtgaaagccacactgacacccatgggcagcaccctttcgtggtcagtggaacttagggatatacggatggaagaagtaaagaaggcccttgtttcttctcttcctcacacaccccaggcatttgctaggaagagaaaggaaacaggg

SEQ ID NO: 13644 - DNA, 1961 bp, Homo sapiens
tgtgtgtatatgcatgtgtgcacatgtgtgtatgtatagttgattcattcattctgacctactgaatttactgaaggaataagaagaaataccttgaactgagggacctggcttagctcaacatctgtaccatctacctttgagtatccattcctttactatgaagcatggatgctaaaactaaaattgcatttgctaaactactttgtagctagattcctgggtgagattagatttggtcaattagatgttcttgtgtaacatttagaaggtgatagtaaggcaaaggtcatgtgactggctgattttatttatgttcaatgatctttattggggtacactttatatataataataaataatgcacacattttaagtgtacaatttgatgagttctgacaaatttatatgcatgtataaccagcatcaatatcaagatatataatgatcccctcattccagaatagtctcttgtgttctttccagccaatgccccacccctggattctggcaacaattgatctgctttttattaccatggattatatttgtctttcctagagatacaaataaatgaaataatgtagtgtgtcctctttaactttggcttatttctctcggcacactatttctgaaatttgtccatactgttgatatggcagacagaattttaagatggttcctaaaattcttgcctcctggtatgtataattttctctcggttttccgctgaacactaacctaggtgctattgtaaagggatttctcaagtgtaattaaagtccctaataagtttattttaagttagaaaaattttcccaggtgagcttgagctaagtgagtgacctaagcaggtgagttgttagaaaaaaattaagagatatttgaagcgtagacaaaattctgttggcttttaaaagaaaacttccatgtgatagagaaagccagatgatagggaacacaaggttacctctaaattgacaaccagcaaaaaagctgagacttcagtcttatcatcataaggaattgaattctgtcaacagccacgtgaccttagaggaggcccctgagccgcagatgagatcatggccctggccaataccttaaattcatcctggtgagatatgagcagagaactcagctatgccatgctcagatttctcacctgtagagcagtaaattaataagtgagcattatttgaagctgctaagtttgtggtgatttgttacacatcaagagaaaacatatgctgtatatattattagatttttcctttatattggtgggtgtatttgttatctattacttcctaacaaatcgacaataattaagtgtcttaagacaacacatatttattacctcatagtttctgtgggtcagaaatctgggcatggtttatgtgagttctttgatttaaagttgttggcaaatctgtaaacaaggaagcagtcaggaccgaggtctcatctgaaagtcaacttgggatgggtctgcttccagcctcacttaacataacagctggcaggattcagttgctcttgggtagttggattgatggcctcagataactaggtagctattagctagatttcaccctcagtttgttgccgtgtgggcctccctaaggtggcaatttacttcatcaaaaccagcaagggagagagttggctacaatctctagtaatgtagctacagaaatgacatccccttagcaatgagatattttattaattagaaagaaattactcaacaggaggggattacacaatgtagtgaataccaggaggctgagatcagaaggagctagtgtagaagctgcctaccacagtgagtagtattctattacatgaatataccagaatgtctgaatccacccaactgggcatagacgtttgtgttcattcaagatacagactattattattttaaaaataaaagttactatgaacatttaagtata

SEQ ID NO: 13645 - DNA, 390 bp, Homo sapiens
tatgtcaatggtgttccagctggtctccccgtcttgcccttctcccgattttctgcccccactttctaaagcatgaaactctttatgtaagccccctgctcaccatcctgcgtggagttcccgcctcaaggccctgcccctgggcctgacactcggagcccttcccagtctaccctcatccttcccctgcccacaggccctcacatcttatctggtcatggaattatctggcattctctggcaattttcagccacctccttccccagctcccaggcctcttggccctgacatctttttataaaccaggacagtgtttaggaattaatgagaacccagacctcagacctggatcctgagcagcagagcagtggatgcccaggctctcgctt

SEQ ID NO: 13646 - DNA, 466 bp, Homo sapiens
ccggagtctctagtctccagtcactgctacaatttatcgttaaatgctcaccagtcaggactgagttaattaaggaaaaacaagctataatcaacccaagtggcaatataaacgtttcttttcaatattgaatttacctaattcgaagctcgggaagcctgactgatggcgttcaggtagtgaatgtgcttggggaagagtggcaaagcgggatttctcagtgtctgctgtttaaggggtctctcactactcttccatcctgagactccatctcagaaactgtcaactccatccagcctcttcccacctgctgccaagggattgccctgggaagcctctcttaaagcccttgtttcttagcaactgtctcactttgaaacaattcagttctacccaatgttgcctgaaagcccatttgtgagagaggttgcagctctcttatgattctatggccagaattgagcct

SEQ ID NO: 13647 - DNA, 1134 bp, Homo sapiens
ttctcactctacagtgcaaatttccttgttgcttcatgggatgtgcataagcatcataagcatcagttttttaattgctgcatgatttttcatcaaggggttacatcgctatatacgtacatattgcggcatattcaggttgcattataattttcaccattacaaataatgtggcaaagaccatttttgtgcatgagcctctttaaatatttactcccaaggcctaggataattttaccagaaaggcctgattagatctaaaagtagaaacacttctatggctcttgagcagtcaatgacttcaggtctccttggcttcctcttctaaagccaaactgtcaccaaggcctctgtatcaaaactgcaattgggaaactgaggctcgctttctttgttaagtggaaattttaggaatggcacatggcaaaagacaagaaacctaaagggaaaacaaacgtccactgaataatccatacctgaacgttaaggcattattgcttccacttcgagaatctaaaagctcatgattctctgaatgatacttaaacattcacaaatgggagaatacaggcattgtatagtactagcttggtgcaaaagtaattgcagtttttaaatggcaaaaccgcaatacttttgcaccaacctaataaatcctaacttttaacttctgtgcaagatatcatttatgtcttccattccagcaaaatgtctggagcttgaagtatttgggatgaactttgttcctggttgagtgggtaactagatgcattgaatagaatgagtgaacacacgccatacgctggctgaagaacttgagtaagaacatgtaagaacttctgagtgatgctctcaaattataaaagctggattttaagaaaaattgaaagactttgtcataattcacttgagagaattaagtatttaccaagagagatgagtgtacagaaaatgatccaaatttaactctgaggaattgaacagtgtctcatgctaaggaatttcttgtgtggctagtatttttatactcatttatttttttggctacgctctaatcgtggttttcttacaaggtggattttgggaaaaaaaatcacagtttttttagtaatgcaatcgatgtaaatataacta

SEQ ID NO: 13648 - DNA, 177 bp, Homo sapiens
ttttttttaatatattgaaggttttttttcagttgattgccttggcccatttttctactgagtggtcattttcttatacatttcaaggagctctttatatgttagggaaattagccctttgtctttaatatgagtggcaatttttccagtttacctcttacttgactttgtttatga

SEQ ID NO: 13649 - DNA, 363 bp, Homo sapiens
atgttttttttcatggaaatacaaaacaatatgtgcttctttcacaactggggtttggaaacagccaaatgatccggactgaaggtcaggcctggttatctatgcaggtattcagggttaaatgcaggtgtgcctacggaaggagtaaaagcagtgacagatagcctggatgtcggtgatctaggagaggaatgtaattccagaaaagaatgaacctaacagaaaagcaattaaacagggatggaataataattaaaatgcagttatcataaaccataatggtagtataataccaacgtatcagtatagacaggagaaaggcaggtaagcctttagaagttaatgcgtcagaaaatgtcagat

SEQ ID NO: 13650 - DNA, 328 bp, Homo sapiens
accttgtacacttctgtgaatgtttttttaaaagcatttttccttttattttttataaattacataaggggatactgggaagatggtgactggaatattttttggtatacttccacacccagttccagtctaggtgcttttcttaaacccaattcagaaaacaagagtataggtaagctgtgaagccctggggctgggagggcagaggagaaccagaaagccacggatccaggggagactttggccgtctcagggagaaagtacaggctcagcacaagtatactcagtctccttggcctccaaaaagtcaagaaggagtttaatgggt

SEQ ID NO: 13651 - DNA, 306 bp, Homo sapiens
ttactcaattacgctttaggcaaagatgtactatccacagctaaaataaatttctactttctgtttcttctcacttctcacaagagttcagcacaaaacaagtgttattaagagagattttttggcttaaattggtacgttaaatatgcttctgttttaaaatattttaatttcatagagcaattttacatgcagaatgtgatcccacttgttcaaatcttggaccgtggtagagaaatgttttggaaagcagcccactttgacctcttctttcccttttatctcgacatctgtgagttttaaagc

SEQ ID NO: 13652 - DNA, 469 bp, Homo sapiens
atttacatataaaatgacattaatcctggaggcaatatgttgtaagttaaattatgtaggatttgaatccaaatcctggatctgcatctcagcagatgttttaccttgtgttatggactgtttatgtctccctaaatgtgtatgttgaaatcccaacccttgttgtaatggtattaggaggtggggtctttgggaagtgatgaggacctgagagtggagccctcatgaactggattagtgccctcataaaaggagcctcaaggagctgggcctgaagaggccctgcaccagatccagacatgctgacacactgatctgagatttccagctcctagaactatgagacatgagtttctgctgtttataagtcacgcagtctatggcactttgacatagaagccggaactaagacaccatggaaaggtatttcagtctatttaagctctagttagttcccttgtggaaaaaa

SEQ ID NO: 13653 - DNA, 339 bp, Homo sapiens
ctgctatttaataaaaccacttctttgcttcctgtaattgtcaaagaaatttaaaatactcaacttcaattaccatctagctgaagaaaatctgagattattttctaaatcaaaaataagttgatggctgaccacagtgactcacaccaataatcccaaaactttgggaagccaaggtgggaggatggcttgagctcaggagttcaagatcggcctgggcaacacagtgagacttcatctctgtaaaaactttttaaaaattagccaggtgtggtggtgcatgcctataatcccgactactggagaagctgaggcagcaggattgctagaacctgggag

SEQ ID NO: 13654 - DNA, 380 bp, Homo sapiens
attctaagtacatcatttcagcagcagtataggacttggatttgaggaagataaaactggaggccttgccaatcaactggaaggtgattgctaagaaagtggtagggggctaggcacggtggctcacacctgtaatcccagcactttgggaggccgaggcaggtggatcacgaggtcaggagatcgagaccatcttggccaacatggtgaaatcccgtctctactaaaatacaaaaaattagccaggtgtggtggcacgtgcctgtaatcccagctacttgggaggctgaggcaggggaatcacttgaacctgggaagcggaggttggagtgagctgagatcacgccactgcactccagcctagagacagagcaagactc

SEQ ID NO: 13655 - DNA, 475 bp, Homo sapiens
ggcacaccctctcttcttgggaattgtaactgtcttgtcagtggcaatcatctccctgatatggtggcccttactgtcaccctcatttaaaaaaattaatactgtatattttaaaacaagcccatgaactggtaacaccttaaataggaattttgacagattccctagaggctgagtgtggactagactgagagtgacaaactgctgggggcacttggtgaagtagccacattggcttctcatggtgaggaacagagaatcctacagtggctctggcaggtggagtggaaaagtaaccattttaaaatagaccaaagcattctcaataacagttctactcaccagggaaaaagactttaccagggccttatccactgctgcagaagggaatttctccaactctagtaccctttggccttcttgtctccccagtatgggagagagaaggggaagggaagaagacaaagccaaaaaa

SEQ ID NO: 13656 - DNA, 710 bp, Homo sapiens
ggcccatggcaaaccaccctatgatggacttcaggtaagaaaaataacctgggaggagttgtgcaggaataacccaaaggtccctataagtgactatgtaagtgcctataactcctgacaaggtcaggccctagaagatgtcacctgagctgggcgcagtggctcacacctgtaatctaacactttcagaagtcaagtcagggtattacttgagctcaggagttcaagaccagcctgggcaacatggcaaaaccacatctctacagaaaaattagctgggcgtggtggtgtgtgtctgtagtcccaactattcaggaggctgagatgagaggatggcttgagcctgggaggtagaggttgcaatgagctgagatcatgccactgcactccagcttgggcaacagagccagaccctgactcaaaaaaaaaaagaaaagaaaatgtcacctggagaaagggacagaaccttgggcacagaggcatcataattttggacagagtcaccagtacagaaagcgaacagacctagtgagatccactgggcaaaccacaagtctcatgaccccaaacccttggctgcacggcttcaggactactcagcaagtagggaggacactccatacagcttagccctggcatcttgagcacctactccaggaaactggtgaaggaagcggtgctcatgatcccaccataggaagaacagagtg

SEQ ID NO: 13657 - DNA, 370 bp, Homo sapiens
ttgattcccaattggaaaataattcacatttagaggaccgagcttcacctgagtgaagacacgggagtgtttggtactagagacctggctgcagtcaagggctgtccctgcccgctgccacctcttgcaggcatctcctttcctcccccatcctggattgagaaccttccgtctgtctgtctgtcctgcacctctgtcccaggcccttcacaggttcctggctgcctctgttgcaggagcctggggctcattctgggctcatgggtgctgttttgtgcttctcttcccaagctgccaaagaagattcttctgcctggtgcctgcatagtgttttcagagtagggatgacaaaaggttttgaattcccctt

SEQ ID NO: 13658 - DNA, 473 bp, Homo sapiens
gcgcggctgggccgggctgctctgcaaaccgctcacgtgctcctgcctttccgagccggggactgcgccagggcgcgcaggaaaaaacacagcccggagctgcaagaagcccttctttcttttctttaatcactcactccccggctttgcgtctcctcccctcgcttgcgggaatgttatgaatggaatgtacggattccagcctgtgcgcgcgcggccaggaatgcagggcgcagcgacctctcgacccacggccagcgcaccgccccagcgccacagcctgggatcccagagccacagcctgggatccctgagccacagcctgggatccctgagccggcccggccgccacgaacactcagggccacgtggcctgacgtctgcagtgggagattcagacggtaagcattcaaagtgaggcgagagagccaagcagcgccgccgggacacaccggggccactctcacgcttcg

SEQ ID NO: 13659 - DNA, 448 bp, Homo sapiens
aaatgaagaggacaacaatgagaaggaacataaagggttagctagcactgtctcctggtgcatggggctgtgcagatgtcccggccacttcttccttcatacttcccttagagaacttgctctgctacaagcagtgggcttggactaaaagtgattaaaataccacaggcataaggagaaaaggagtatatgtagtagtaataattactagtataaattattttcttcacatgctatgagtaataatattaaaaaactcattttaccattaagattccttatgctgaagctcttccatttagaatactgtcaatgtcatttactggtatgaactaaagtcccccttcttttccactcactgggaaccttagtaaaacaccagcatatcttacctctctttctgactggccgatgcttccagagactgaatgttgggaaaacctagtag

SEQ ID NO: 13660 - DNA, 274 bp, Homo sapiens
tttttgactgaaagtacagatacaacttccctttccagccaagatggaggagcaggggccaagtttatcctcctgcctgaaacaaccaaccaaacagtaaatacatgaaataatgagtttcaagacactggacatgaggtaacaaaagacagtgatctctcagaggcaagaaacaaacaaggagaacccctcggttgcccagcttaccgcttgagaggatgtatttcacggagggagaacccaggcaaagcaagtgactctgaggtgaggggat

SEQ ID NO: 13661 - DNA, 431 bp, Homo sapiens
ttcaatattatgaattattccctgagacattacagaagttgagaatgaattgtgccccataaacagaaaacatattaaccctatacaatacactcgttttcccttttagagacacgaatacccctagcctcaaggagtcgatatgtataaaataggcaactaggggcatgcaaatattgtggaaatggtgtttctgattggcactggcagatttattattcgaaataatcctgttggcaaaaaaaggaaattttttttccgtatcataaaatctgatttcaaaaacttgctcctttttgactttctctataagcttgtaagtctgcattcttctctcatttttatatccaggctctattgtaatttatctgttgctaaccagttttcaataaaatatataataaataagattttcggtttttatttttcaa

SEQ ID NO: 13662 - DNA, 676 bp, Homo sapiens
aaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactattaaaaaaaaaaat

SEQ ID NO: 13663 - DNA, 639 bp, Homo sapiens
aaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagccatttaggtaacagccatttaggtaacagccatttaggtaacagccatttaggtaacagccatttaggtaacagccatataggtaacagccattcaggtcacagccataaaggtaacagccattaaggtag

SEQ ID NO: 13664 - DNA, 409 bp, Homo sapiens
ccacctttctctgggaaatcgatagcttgaccctgaaggcttaccatgtgtcagacaatgtgctaaaagctttacattcattactcgttcttgcaacagcctttcaaaataggtgtttatgcccagtgtattgttaggaaaacacgtgaggttaaactacccactgtcacatatgggataggtggcaaaatcacagaatccaggtctgtatgacaagtgagtgcttcactatattcgtaaacaaagtatccaccctgggatcaaaaaacaaaagctcaataaatgccaactgttggcctagcaaaaaatagaaaattgtgaatatttacactctgaaataattgatttcaccccagtttagaaaagaatgtttaagggttgagaatttaaaggcttggtttcctgtttg

SEQ ID NO: 13665 - DNA, 2582 bp, Homo sapiens
ttcttaacgttacatatattatcttatagaaataactaagggaagttagtgccttgtgaccacatctatgtgactttaaggcagtaagaaactataaggaaaggagctaacagtcgtgctgtaagtagctacagggaattggcttaaagggcaagcttggttagtacttagctgtgtttttattcaaagtctacattttatgtagtggttaatgtttgctgttcattaggatggtttcacagttaccatacaaatgtagaagcaacaggtccaaaaagtagggcatgattttctccatgtaatccagggagaaaacaagccatgaccattgttggttgggagactgaaggtgattgaaggttcaccatcatcctcaccaacttttgggccataattcacccaaccctttggtggagcctgaaaaaaatctgggcagaatgtaggacttctttattttgtttaaaggggtaacacagagtgcccttatgaaggagttggagatcctgcaaggaagagaaggagtgaaggagagatcaagagagagaaacaatgaggaacatttcatttgacccaacatcctttaggagcataaatgttgacactaagttatcccttttgtgctaaaatggacagtattggcaaaatgataccacaacttcttattctctggctctatattgctttggaaacacttaaacatcaaatggagttaaatacatatttgaaatttaggttaggaaatattggtgaggaggcctcaaaaagggggaaacatcttttgtctgggaggatattttccattttgtggatttccctgatctttttctaccaccctgaggggtgtgggggaattatcattttgctacattttagaggtcatccaggatttttgaaactttacattctttacggttaagcaagatgtacagctcagtcaaagacactaaattcttcttagaaaaatagtgctaaggagtatagcagatgacctatatgtgtgttggctgggagaatatcatcttaaagtgagagtgatgttgtggagacagttgaaatgtcaatgctagagcctctgtggtgtgaatgggcacgttaggttgttgcattagaaagtgactgtttctgacagaaatttgtagctttgtgcaaactcacccaccatctacctcaataaaatatagagaaaagaaaaatagagcagtttgagttctatgaggtatgcaggcccagagagacataagtatgttcctttagtcttgcttcctgtgtgccacactgcccctccacaaccatagctgggggcaattgtttaaagtcattttgttcccgactagctgccttgcacattatcttcattttcctggaatttgatacagagagcaatttatagccaattgatagcttatgctgtttcaatgtaaattcgtggtaaataacttaggaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttgtttagaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtagattaaatagatctgatttttgccatcaatgtaaggaggataaaaacttgcatacccaattgtacacccttgcaaaatctttctctgatgttggagaaaatgggccagtgagatcatggatatagaagtacagtcaatgttcagctgtaccctcccacaatcccacttccttcctcaacacaattcaaacaaatagactcagactgtttcaggctccaggacaggaagtgcagtgtaggcaaaattgcaaaaattgagggcacaggggtggagatgggggggttgaataacaagctgtgctaaataattacgtgtaaatatattttttcatttttaaaaattgatttcttttgcacattccatgacaatatatgtcacatttttaaaataaatgcaaagaagcatacatccaagccactgagctcatttgtcttctgttttgataaagtggtaaagaaggaactaacatgggaatgcattgctacaatttaaataagcataccaagataaattcatttatggtgctttgagtatatgagaccctcttctaccagacagatgatcagtgttagatttatagagaagggattatcaaattcccatggccaagaaggtcagaga

SEQ ID NO: 13666 - DNA, 408 bp, Homo sapiens
catttattagccatttgtttatcttcctttgtgaaatgtcttttcaagttctttatccattttaaaaattggattttgtttttattgagttgtaggagttcttttagtttttttttggtatatatatattctgcttttaagtcttttctcagtagttttgctaggttgtgaagatgtttttaatgcatttttctagagggtttaccaatttatcatttaacctttgttaaggtctatgatttattttgagctactatatggagggaagtagggatcaagtttcttcttccttttttttgtgtatggatatcctgttgttctagaacctactttggaaaacactttttccattgagttgctttgtcacctttattgagtagttgacctaagtggtctacttctggagtc

SEQ ID NO: 13667 - DNA, 422 bp, Homo sapiens
cccaccaccatgcctggctaatttttgtatttttagtagagaaggggttttgccatgttggccaggctggtcttgaacccctggcctcaagtgatctgcctgcctcggcctccaaaattgttgggattacaggcatgagatactgtgcccagcccagaataatgtttttaatcgtgcagaatcaatcactatggaaactatgttgaaatgcgggtgctgtctttgagaccctgatagcagtgtcttccacagtgtagcaagtgtgtgagcttttacttttggaatggtatctctaatggtttctttctttctttttttttttgagatggagtgtcactctgttgtccaggctggagtgctgtggcgtgatcgagcttacaccaccgcactctagcctgggcaacagagcgagattccgactc

SEQ ID NO: 13668 - DNA, 366 bp, Homo sapiens
atgaactgtcatttactatgtattagctaggtacagtactgtaggccaccagctttttcatgaaattgtgtgctttggtatctgtgtgctttctctcgtttcctctgtatctctgtgtgtcattctctatgtgttactccttgtgggtcattctgtgggacgctcaatatctgggttggaaagtctgagcggatgcctctgtctcttcgtttctcactttgtatgtttgtgaatgtgacccctgtgggcttgtctcctccctggggccctctcttctttccatcccattttatttaatgtgggtcttctatacccattcagtcccggtttcccctctccatatactccatcatatgctaggttttg

SEQ ID NO: 13669 - DNA, 651 bp, Homo sapiens
gttacactttgagatttttatggtgaattctagtggtgagatccagtctattttgtctctctctctttttttaatttttttctttttccctcatacccatatgaagtaatccaatggggaatgcaatattagaaatagatttttaagagagaacaaggaaaaaaatgcaagatcttatatttttcatgtgatgacctgttctgtatttatgaggaagtccattctatggaaaagaaaagaaagtaagcaaacaacagattaatttacatatgagcatctataaaacccatgacttttaaacaactctagaaccagaatttgtagttaaaaagctaaaaataagattataaataaaatattgtcggtttttctgtacctggacacaactcatttgtagtatggctcaaatgtgagaaacttgaaggtaattagattttctgctttctaagaaagaaaatatgacagtattctttagtcacaaaatcaaatctctacagggtcctgtttgactagttgacttgagttttagatgtatgtttaaggatgctgtggtattttttccttctcattaattaggcttaccctttgtagaatgctcaggttcaaaaataatgattttgtgaagtaaatttaattctacttgaaaaaaaa

SEQ ID NO: 13670 - DNA, 284 bp, Homo sapiens
aaaatatatatatatatatgtgtgtgtgtatatatatatcaattaaatagttaaagtcagaggtctaaaatagcagtttccaaaatgctagtttctcaatcttttttcttcgttgtccctaagcataaaaatcaattaattagataattttccatttaaattggatccaatgtttccctaatgagataaattaaatactaaggaatacaattttgtcaggtagaggtgacctttggaaggccataaaccattgtaataactaagatttttttttcacttttcaa

SEQ ID NO: 13671 - DNA, 351 bp, Homo sapiens
aaagggaaataaagcagccactgcacatctgcacatataacctgtagatctgggggctctaataaaaaagttaatggcaatgtcaaaatctggtgttttatcttagataacttcatagtcattgattgagccccttaaaaataacatttaaaggacatgtagtcattctgtttctttattgccaagttttcagcaatttttctcatgagaatgagtgctaagaaacttttggtggagcgtggtggctcaagcctgcagtcttgcactttgggacgccaaggctggccaattacttgagatcagtagtttgagaccaccctggccaacatggtgaaaccttgtctctactaa

SEQ ID NO: 13672 - DNA, 809 bp, Homo sapiens
tgattctcctgcctcaaccttcctgagtagctgggattacaaccatgagccaccatgcctagataatttttgtatttttagtagagacgggggtttctccatattgctcaggctggtctcgaactcctgacctcaggtgatctgcctgccttggcctcccaaagtgctgtgattacaggcctcagccaccctgcctggcctccctgttttcaaggtcagtagctgtgtgttttcacttctgcattttatatatgttactataattttcttgtaagaagaattaaatgttgaaagtcaatagcatcagaacgttgcaaaagaagtttctttagcccaggtatgtgaaagatgcttctctaattttcaaagagaggtgataagaccaaccctttccattagcccttctgggcccccatgtaagaattcagacacaccttctcactcatctcagaccttctcagggtaactcggtgaatatgtccccactctgaggatatcacagctaaatgtaaagcaggtcacatcagtccctggcagggaaccctccaccagcttcccgtgttccccaggacaaaagcccaactcatcagtgtggctccacagccctgtgtccagggcccctgccagtgtccagcctcctctgacatgaaggtgtccaaaccctcctgtgattgtgtgggccaaagggatcaggagacagagagagagcagtaaaaaacctgagacagagaaaagaagaatgagaaaggcccataacagatggcaaagtagaagatgggtgagggatttgccaaaaaacagcaaaagtg

SEQ ID NO: 13673 - DNA, 464 bp, Homo sapiens
tgaaggtcacaccacagcgcgtgagtttcgctctgttttatgtgtgcttcccagtcctgtggtgctgctataccggggacgttgagtccccacagacctggaaattgcggcccctctttctcaacccagagcaaattgagacgtccgggctggagtgcaatggcgcgatcttggctcaccacaacctccgcctcctgggttcaagtgatctcctgcctcagcctccccagtagccgggattacaggctgtgagtgcagtctcctgatcttggctcactgcaacctctgtctcctgggttcaagtgattcttgtgcctcagcctaccaagtagctgagatacaggattgacttctaaagactcttggtacctgaggaagaaacccagaagaggaagaggaaagcaaaggagtcggggatggctctttctcagggtctgttgacattcagggacgtggccatgttc

SEQ ID NO: 13674 - DNA, 188 bp, Homo sapiens
gtggaggtgatggagtttcgctgtgtcccccaggctggagggcagttgtgcgatcttgattcacttcaacctctgctttccgggctcaagcaattctcccacctcagcctggtgagtagctttggttgtgtcctctccaggtttttgcttataccttctgaacgcaagttaatttaagtgtgtgtgga

SEQ ID NO: 13675 - DNA, 883 bp, Homo sapiens
tgaaggtcacaccacagcgcgtgagtttcgctctgttttatgtgtgcttcccagtcctgtggtgctgctataccggggacgttgagtccccacagacctggaaattgcggcccctctttctcaacccagagcaaattgagacgtccgggctggagtgcaatggcgcgatcttggctcaccacaacctccgcctcctgggttcaagtgatctcctgcctcagcctccccagtagccgggattacaggctggagggcagttgtgcgatcttgattcacttcaacctctgctttccgggctcaagcaattctcccacctcagcctggctggagtgcactggtgccatctcagctcactgcaacttctgactcccgagttcaagtgattcttttgcctcagtctcccaagtagctgggacaacaggggcgtgccgagaagcccagctaattttgtacttgtagtagagagcgggtttcaccacgctggccaaaattgtctcaacctcttgatctcatgatccaccgcctcaccctcccaaagtgctgggattacaggcatgaggtaatgcgtgtggccaagcccatggtttacgtagaaaacacagcatttgcaatatatatacataattattattgttattattattattttgagaaagtcttgctctgttgcccaggcccgcattggggaggtgcctggggcctatatggtggcacaaggtgttcttccctgcccagtgccagcccctggaaaatgggctcctctgacatgaaggtgtccaaaccctcctgtgattgtgtgggccaaagggatcaggagacagagagagagcagtaaaaaacctgagacagagaaaagaagaatgagaaaggcccataacagatg

SEQ ID NO: 13676 - DNA, 953 bp, Homo sapiens
ccatctgatccgccacgatgtgccctacctgttccagaagtacgtgaaggagtcccatggaaaggacatccgggtggtggtggtagggggccaggtcataggctctatgcttcgctgctccactgatggacggatgcagacaactgtctcttcggtggcgtgggcgtcaagtgtccgctgacagaacaaggcaagcagttggctattcaggtgtccaacatcctaggcatggacttctgtggcattgatctccttatcatggacgatggctcctttgtggtgtgtgaggcaaatgctaatgttggcttcctagcctttgaccaggcatgcaacttagatgtgggtgggatcattgcagactataccatgtccttgctgccaaataggcagactggaaagatggctgtcctcccaggactgtcgagtccaagggagaagaacgagccggatggctgtgcttcagctcagggagttgcagagagcgtctataccatcaacagtgggtctacctctagcgaaagtgagcctgaactgggagagatccgggattcctcagcaagcacaatgggggccccaccctccatgctgcccgaacctggctacaacattaacaacaggattgcttctgagttaaaacttaagtgaattcctgctttttggcagcatttaaaccaaatcctactgcttccctagtagttttgagtgaataaaatctggactaatgtgatttcatttgcacagaaactagaaatcccatctgggcactcagcattttttctaacgatgatttaagcaaatggcctagctttgtggtttttacaaagacaaatataaaaacactcacaagaacaacgtcccgactgatcagtatgagactgatgtctgctgtgagcacgtggatattacggctgacgctaaggcactgactctgctgttgcttctgacttttagca

SEQ ID NO: 13677 - DNA, 4163 bp, Homo sapiens
  misc_feature (1062)..(1062): n is a, c, g, or t
  misc_feature (2022)..(2022): n is a, c, g, or t
  misc_feature (2173)..(2173): n is a, c, g, or t
caaggacagcctaaacatttatagcgggtccatgctttttggctttctagtggcaaccaagtagcttgatgtgattttaagtgagttttacacatgctctttctcttatatatgatctcagacataagaggcaatttaaggaatcttgtagcaaaatctaaagcaaagaattagaaagtataaaaaaattctcaatatatcttttggtaaggtagaacatacatatctgaagttgcattcaagtacatggagatatacatgtatttcttctctcgagtgttgcctgtgtatatgtatgtgtttgtgggaagctatgcaaatacagatcctgtgagtagaaatatacctttattttttgaaatggtttattttacaacccaagataaagtagaaatcagggtaaaatatactgtttagctacttttttgagacaggaaaggaatgacattcctaattcatagcaaagagtgcgtgtaggtaacattatttattcacatatttgtgcacacaaaatccactcaaatatccatttaaacagctaatatatttatatgtactactctaacttgtatttttactaaaattatttatgtatgttatcactagtctcaaaaactgatgcccaagttaaatgtggacatatctttttttacagtgaactaaagcaaaaagaccggggtatatttaaaaatatatttaaaatatttaaaaaatctaaatttatgccatcttctgggataatgccaaagacaatttcaactgtagcactctgtataattaaacatgttttatgtcattgttcttgaattttttgttgctttattgttcattagaattactctttttttttttttttttttgaaaaaagagtcttgctttgttgcccaggctggagtacagtggcaccatcttggctcactgcaacctctgccttctgggttcaagtaattctcatgcctcagcctcccaagtagctgggattacgggcatgtgccaccatgtctggctaatttttgtatttttagtagagacagggtttcaccatgtgggccatgctggtcncgaactcctggcctcaagtgatccacccgccttggcctcccaaagtgctgacattgccagcattacaggcatgagccactgtgccgagacagaattattcaattctaagtaggtatgacttctgcttgtgtcttaggatttggggcatttctatgcagaagaaatactgttcattttagttagttagtgataagtatttagttccctaatgaactgcgaataataattgctgaaaaccagttacacttggggggtgtttacacttgggagttgcttctggatccatagctgagtagaagacatgacagagtgattaatcagatctcgtctacagacttccatttatactgataatgaccataatagatgggcctgtcactaggctaagaaatttacatgtgtttttatttaatctttccaacagtcttacgggatgtgcgtactgttattccagttttgcagatgaagaagctgggatttagtgaagttaaataactagtaaatagagagggctatgttccatcctaagttgcttttgattccaagactgctatggtattttgagacggctgatttggtacaaaagaacttgattgaaatcattttagtctaatctcctggagccatgctactttctatggtactatattaaaaagagataatacacagatagcagatacaaaggttgaaatcagaaacctatagtattccctgtgtaataatggatttcttgttgcttttataataagtttttaaatagctaatgcatacacatagtaaaaaataattcagatagccagagtgtctatagagtgcaaagtatgtctttttcccacaccagcctcctattcccccacacagaagcaaccattgtatctaaattgtggttattcttccaaatatggtgttaacatgaatttatttttatttttattttgcccaggctggagtgcagtggcncaatcatagttcactgcagtgccaaactcttgagctcaagcaatcttcctgcctcagcttccgtagtagttgggactagcaagcatgtgtcaccaggcccagctattatttttattattttatagacctggtgtctccgtatgttgcccangctggacttgaactcctagtgtcaagcagttctcctgccttggcctcccaaagcactgagattacaggcatgagccaatgtgcctggccattagttgtttttttaaaaaatgacatttgagcatcaattcttaagaaaactagaagagccagatcttgtaccagattgacatctgaatgggccaagctagagaaggctggagaaggatgcagatgacacaccttcagtgatgagagtgtcagatagggcgtcagcattacccaccatccccataggggtaacagaaagcccttgcagcaggtttgtcttgtttcatagatgagaaaattggttacttaggtcatgtagggagttgcaggtagagcagaactcagatgcagaaatatgcttctcatttttccaattctacttcagcacaaatgacttgtggatttgagagtgtaacgaagaattgtacaattgaaattgtacaattccaaaattgactaagggtttctactggtaagccagatagcaaacttcagaaagccaaagtcagtagcagatattaaaaaaaaaaaaaaacttttaaaatacatctttttattttagaataaatttagatttacagaaagcatgtgaagatattaaacagagttcccatgtatgctacacccagtttcccctattattaataggtttatccactatcaggttactctggaaggaagtcactatatgcagcctacacataagaagtggaagattatgttccaccttcctgagggctaagtaaattatttggaatgcttctgcacaagaaatttgtctgtcattctgtttatttattttttcagtcaaaacttatttattatctttttgagactctctctgttgcccaggctggagtgcagtggcgtaatcgtagctcactgccgcctcgacctcctgggcttgagccatcctcctacctcagcttcctaagtagctgggactacagacacgccaccatgccctgctaatatttgtaattttttgagagatggggtttcaccatgttgcctaggctgatcttgaactcctgggctcaagtgaacttcctacttcagcctcccaaagttctgagattgcaggtgtgagtccctgtgcccagcctcagtcatttacatatataaatatggctcatggattatatgatttttgggttataatccagtactacagttttattgctcaaattgttccaactttggccattgagagctcttttagttgacttctatatctctttaacacactttcatcattgtgttttatttttgttttctattttgagcgcttcgctttcctacactgcaggatgctccagattcgccttttatatttcctgcttcactcctagaatcagctttttctccatggaagtccgattctttttattggaaaatagtattggaaaccaagatctgggtgccagttgtaattgcagctcttttaaaaccaaatattgaatagaaaaggaagttttagccattttcccaggtagtactaaattaagtcattgcaataatttatataagttcactggattgaatggaatgatcctaaggatttttaagggaaaattctaagaattcttattactgttttctgttacttttttaaaaaaattctgtaatgatatcacttgatttgattttttttgtgtgtccttgaccaaaaaacttgaggcaaaacttcaaaacatggtaatttgaagcaggttgggattaactctgggatattggaaagactttaaactccattaggaaaattaacaagcatgtagtctataaaagacatgtaattcatatttatataaagaataatactttcttccaccttcagacatctaagatttaaaaaaatgttctttttaaaagaaagaatagtactttcttttgtatcactaaacatttcaaatttgtgtattgaacagaggattggggagaatgttttgttaaggaaagag

SEQ ID NO: 13678 - DNA, 3621 bp, Homo sapiens
  misc_feature (1062)..(1062): n is a, c, g, or t
  misc_feature (2022)..(2022): n is a, c, g, or t
  misc_feature (2173)..(2173): n is a, c, g, or t
  misc_feature (3479)..(3479): n is a, c, g, or t
  misc_feature (3528)..(3528): n is a, c, g, or t
  misc_feature (3552)..(3552): n is a, c, g, or t
  misc_feature (3574)..(3574): n is a, c, g, or t
caaggacagcctaaacatttatagcgggtccatgctttttggctttctagtggcaaccaagtagcttgatgtgattttaagtgagttttacacatgctctttctcttatatatgatctcagacataagaggcaatttaaggaatcttgtagcaaaatctaaagcaaagaattagaaagtataaaaaaattctcaatatatcttttggtaaggtagaacatacatatctgaagttgcattcaagtacatggagatatacatgtatttcttctctcgagtgttgcctgtgtatatgtatgtgtttgtgggaagctatgcaaatacagatcctgtgagtagaaatatacctttattttttgaaatggtttattttacaacccaagataaagtagaaatcagggtaaaatatactgtttagctacttttttgagacaggaaaggaatgacattcctaattcatagcaaagagtgcgtgtaggtaacattatttattcacatatttgtgcacacaaaatccactcaaatatccatttaaacagctaatatatttatatgtactactctaacttgtatttttactaaaattatttatgtatgttatcactagtctcaaaaactgatgcccaagttaaatgtggacatatctttttttacagtgaactaaagcaaaaagaccggggtatatttaaaaatatatttaaaatatttaaaaaatctaaatttatgccatcttctgggataatgccaaagacaatttcaactgtagcactctgtataattaaacatgttttatgtcattgttcttgaattttttgttgctttattgttcattagaattactctttttttttttttttttttgaaaaaagagtcttgctttgttgcccaggctggagtacagtggcaccatcttggctcactgcaacctctgccttctgggttcaagtaattctcatgcctcagcctcccaagtagctgggattacgggcatgtgccaccatgtctggctaatttttgtatttttagtagagacagggtttcaccatgtgggccatgctggtcncgaactcctggcctcaagtgatccacccgccttggcctcccaaagtgctgacattgccagcattacaggcatgagccactgtgccgagacagaattattcaattctaagtaggtatgacttctgcttgtgtcttaggatttggggcatttctatgcagaagaaatactgttcattttagttagttagtgataagtatttagttccctaatgaactgcgaataataattgctgaaaaccagttacacttggggggtgtttacacttgggagttgcttctggatccatagctgagtagaagacatgacagagtgattaatcagatctcgtctacagacttccatttatactgataatgaccataatagatgggcctgtcactaggctaagaaatttacatgtgtttttatttaatctttccaacagtcttacgggatgtgcgtactgttattccagttttgcagatgaagaagctgggatttagtgaagttaaataactagtaaatagagagggctatgttccatcctaagttgcttttgattccaagactgctatggtattttgagacggctgatttggtacaaaagaacttgattgaaatcattttagtctaatctcctggagccatgctactttctatggtactatattaaaaagagataatacacagatagcagatacaaaggttgaaatcagaaacctatagtattccctgtgtaataatggatttcttgttgcttttataataagtttttaaatagctaatgcatacacatagtaaaaaataattcagatagccagagtgtctatagagtgcaaagtatgtctttttcccacaccagcctcctattcccccacacagaagcaaccattgtatctaaattgtggttattcttccaaatatggtgttaacatgaatttatttttatttttattttgcccaggctggagtgcagtggcncaatcatagttcactgcagtgccaaactcttgagctcaagcaatcttcctgcctcagcttccgtagtagttgggactagcaagcatgtgtcaccaggcccagctattatttttattattttatagacctggtgtctccgtatgttgcccangctggacttgaactcctagtgtcaagcagttctcctgccttggcctcccaaagcactgagattacaggcatgagccaatgtgcctggccattagttgtttttttaaaaaatgacatttgagcatcaattcttaagaaaactagaagagccagatcttgtaccagattgacatctgaatgggccaagctagagaaggctggagaaggatgcagatgacacaccttcagtgatgagagtgtcagatagggcgtcagcattacccaccatccccataggggtaacagaaagcccttgcagcaggtttgtcttgtttcatagatgagaaaattggttacttaggtcatgtagggagttgcaggtagagcagaactcagatgcagaaatatgcttctcatttttccaattctacttcagcacaaatgacttgtggatttgagagtgtaacgaagaattgtacaattgaaattgtacaattccaaaattgactaagggtttctactggtaagccagatagcaaacttcagaaagccaaagtcagtagcagatattaaaaaaaaaaaaaaacttttaaaatacatctttttattttagaataaatttagatttacagaaagcatgtgaagatattaaacagagttcccatgtatgctacacccagtttcccctattattaataggtttatccactatcaggttactctggaaggaagtcactatatgcagcctacacataagaagtggaagattatgttccaccttcctgagggctaagtaaattatttggaatgcttctgcacaagaaatttgtctgtcattctgtttatttattttttcagtcaaaacttatttattatctttttgagactctctctgttgcccaggctggagtgcagtggcgtaatcgtagctcactgccgcctcgacctcctgggcttgagccatcctcctacctcagcttcctaagtagctgggactacagacacgccaccatgccctgctaatatttgtaattttttgagagatggggtttcaccatgttgcctaggctgatcttgaactcctgggctcaagtgaacttcctacttcagcctcccaaagttctgagattgcaggtgtgagtccctgtgcccagcctcagtcatttacatatataaatatggctcatggattatatgatttttgggttataatccagtactacagttttattgctcaaattgttccaactttggccattgagagctcttttagttgacttctatatctctttaacacactttcatcattgtgttatttagttctattngagcctccttctcatgagatgtcaatcgcttatttctgtcatcagatanttttcatgagccatctttatgaangatgacaactgggcgtgaattnagtttaacattgatgaagagtagcatttttcccaggaggactttagt

SEQ ID NO: 13679 - DNA, 3637 bp, Homo sapiens
tttttcttttggattatatccctggaaagaattcccaggggtgggaattacttggtcaaaaaacatgatttacatatgtttatttacatataattatgtaatttatatgctgtcttttaaagaagtgttggaatagctttgaccaactacccagtttcattgtgaatccagaggtgtacagttttacccaaattttgaagaattgaagctcatatgcttgaaaaataatataatcacagttttactctactcattaaaaattatttccaatgtaaattttttataattttcagtgaccagtgtaaccaatattttaattttttcagagtacatgtgatgcagaaaagtcttacgaagtattactgagctttgtgataagtgaactatttaaaggaaagttataccatgaagaaggaactcaggaatgtgcaatggtatgtttctgcaaaaatcagatgtagcggttatttagtaaaaaatttacattttcttgccattatgaatgtaatttttaaaaactctttattgtagactgacttgttcaaattttcttttttaactttaggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcatatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactataaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttac

SEQ ID NO: 13680 - DNA, 3506 bp, Homo sapiens
tttttcttttggattatatccctggaaagaattcccaggggtgggaattacttggtcaaaaaacatgatttacatatgtttatttacatataattatgtaatttatatgctgtcttttaaagaagtgttggaatagctttgaccaactacccagtttcattgtgaatccagaggtgtacagttttacccaaattttgaagaattgaagctcatatgcttgaaaaataatataatcacagttttactctactcattaaaaattatttccaatgtaaattttttataattttcagtgaccagtgtaaccaatattttaattttttcagagtacatgtgatgcagaaaagtcttacgaagtattactgagctttgtgataagtgaactatttaaaggaaagttataccatgaagaaggaactcaggaatgtgcaatggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcatatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactataaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttac

SEQ ID NO: 13681 - DNA, 2507 bp, Homo sapiens
gatgagaaccgtccagctcaatgtctgcagcagcgaagaggtggagaaagtggtggagatgtccgctcgagcctgaaggaccctgagaaaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcatatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactataaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagattactgaaaagcatgtgacatattgctacaaagattttttttcctaaatgattcagtaattgaatgattatttaatatatagtgctatcaagcaatccctggtactttggacttccatggcttgttatataaaattacatttttacatgtaaaaataaactaaacaaatctaatgataaaatataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttac

SEQ ID NO: 13682 - DNA, 3581 bp, Homo sapiens
tttttcttttggattatatccctggaaagaattcccaggggtgggaattacttggtcaaaaaacatgatttacatatgtttatttacatataattatgtaatttatatgctgtcttttaaagaagtgttggaatagctttgaccaactacccagtttcattgtgaatccagaggtgtacagttttacccaaattttgaagaattgaagctcatatgcttgaaaaataatataatcacagttttactctactcattaaaaattatttccaatgtaaattttttataattttcagtgaccagtgtaaccaatattttaattttttcagagtacatgtgatgcagaaaagtcttacgaagtattactgagctttgtgataagtgaactatttaaaggaaagttataccatgaagaaggaactcaggaatgtgcaatggtatgtttctgcaaaaatcagatgtagcggttatttagtaaaaaatttacattttcttgccattatgaatgtaatttttaaaaactctttattgtagactgacttgttcaaattttcttttttaactttaggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgagggagaaaaagaaaacatacattatgaagcctttccaaaattaggtgcttggtaatcacgttaatggtataattttttttttttaatatctggagaacattaataacaagttaaattattctttagtggtcattttttaagtgcacaattaataagaagcacaacttgttcacaaactcattcagaaatgattctcccaacaatgcatatcagctattcattgatacttagagtgggtgtgatttatttgacattttactgcttctttctgtctgtgtgttttaatttgcatctgccaagcataatgcatcttttttcctctgccattcttgtgttgattggagaatttttctgtatgtaattagaaaaaaatgtaaaacatgatttatgtgaaatactgtatagtaaaagttggtctaatagtagaactttaaaattttttcttattgtgaggaatctgttaaaagtttaaagctttgctgaaaactgaattcattctcaggaatttcataaatcttctccccaggtaaataattgaaatagctgtaaaataagtagatagctgctgttaatataatacagtacattttggggggcatatgtgtggttggggggtccttaaaaatcaaaatttgccatttcagttggatgaattactagaggtaataacaaatcttactataaaatcaagaggtttaagaacatacactgggcagatgttgattccgtgcatgcccaccttttattaccaaacaaggttttgtttatatgattgtattagaaatgctcagacttccccagaaatgaaccataaattttggaacttcctttcagctcaagaggttcagctatattgtatttgtgcagtgtaatcactactatttctgctcggtttcctaaaaggaaaaaaaaggcgcagtggtgatgaccctcatgaatgagccacgcttctgcattcttcttagaaactgctgtgaaaaacaatttatgtttgcagggtttaaaaatcagtaaaaatgggaatgattgagctaaaacccactctatgagaaggaagataattgaatgattatttaatatatagtgctatcaagcaatccctggtactttggacttccatggcttgttatataaaattacatttttacatgtaaaaataaactaaacaaatctaatgataaaatataatgtcagatccatgttctaaaaaatttttgtaatgacatgacattacaagagtataaaaatggacattaaatcatggccttgcattaaaatatggaaagcagagcagtacatattcaaatgtattcagaaagtcaaaagattacctatcgttctacaataaaatacatggaaatagcttgctatttttatatacatttccaaaatattaagataactttctgtaagagtcaatgattctgttcgactaaatagctgtcctttccaacacattgctacttttttaaatactgtatcataagttcagcctgtcatactttttgcattgatcgttatgaataccagaccatttgtaagtgtggttgaagagcaaaatgctaattgacatctctagtaaatactgttacaggattcatgaacttgaataattctacagtttgaaactctgatgctatatatacatggtataatgtattcagactttgattactacttatttaaaatggaatgttttatggttgtgcatatggatgtgaagtgaaaatattagccttaactttaaaatttgggtgtttgatagtgtttattttgatattggtgaattagtcaccagtaaattttaaaaaagcacttggttgaaaattgtacttgaatacatacatgcatgctgctaaactagaactttaatttttccccataacttttataagtcccatttataaacccacttttaaaaataacaggtccaagttagagtgatgtgtgtatattattcaaaaaaatgtactggtgtgatatcttgtatgaatgatcatttaaatacagtacattactgtagaagctaaattgatctttataattaagcagaaattacaaaactaggaataatcaacattgtaagatatgttaataaaaacctgctgtcatttggtttgtgaaaggtccttaaaatgtttac

SEQ ID NO: 13683 - DNA, 1492 bp, Homo sapiens
  misc_feature (1448)..(1448): n is a, c, g, or t
tttttcttttggattatatccctggaaagaattcccaggggtgggaattacttggtcaaaaaacatgatttacatatgtttatttacatataattatgtaatttatatgctgtcttttaaagaagtgttggaatagctttgaccaactacccagtttcattgtgaatccagaggtgtacagttttacccaaattttgaagaattgaagctcatatgcttgaaaaataatataatcacagttttactctactcattaaaaattatttccaatgtaaattttttataattttcagtgaccagtgtaaccaatattttaattttttcagagtacatgtgatgcagaaaagtcttacgaagtattactgagctttgtgataagtgaactatttaaaggaaagttataccatgaagaaggaactcaggaatgtgcaatggtatgtttctgcaaaaatcagatgtagcggttatttagtaaaaaatttacattttcttgccattatgaatgtaatttttaaaaactctttattgtagactgacttgttcaaattttcttttttaactttaggttaaccctattgcttggtctcctgaatccatggaaaaatgcttacaggacttctgcttaccttttctcagaatcaccagccttcttcagcaccacctttttggggaagatttacctagctgccaggaagaagaagaattttcagttcttgccagctgcctgggacttctgccaacgttttaccaaacagaacatccattcatcagtgcctcctgtctggattggccagttccagcatttgatattataactcagtggtgttttgagataaaatcatttactgaaagacatgcagaacaaggaaaggccttgcttatccaagagtcaaaatggaaattaccacacctactacagttgcctgagaattataacaccatttttcagtactaccacagaaaaacctgtagtgtctgcaccaaggttcctaaagatcctgctgtttgccttgtgtgtggtacttttgtatgcctgaaaggactttgctgcaagcaacaaagttactgtgaatgtgtactgcactctcagaactgtggtgcaggaacaggtattttccttttgatcaatgcatcggtaattatcatcattcgaggtcaccgcttctgcctctggggttccgtgtatttggatgctcatggagaggaagaccgggatcttaggcgaggcaaacctctctacatttgtaaggaaagatacaaagttcttgagcaacagtggatttctcatacttttgatcacatcaataaaagatggggtccacattacaatgggctgtgactctccacctcagcattgcatcgtatcatcattttcgctacgaatttatttttcaacaataagctttaacttaatttgggggattaacacttttgctgaggggagtggnataatttttttttaaatctggggaacatattaacagttaattat

SEQ ID NO: 13684 - DNA, 223 bp, Homo sapiens
aaaatcatagtatatatatataggatttggtgcttccatactttcaggcatccactgggagtcttgaaacgtgtcgccctgggataagggggacaactgtatgcacaattctttgtccaaaggactcatcctccagggaggaagggagaagggtgaagatgctcagagtacaggtgggccactggctctcccaagacattccatccatttctggaacgtcatt

SEQ ID NO: 13685 - DNA, 458 bp, Homo sapiens
ctgtggatctcctaaagcaggaggtgatattcaatgttgtccgcctggctgctaccatcatcacctgccattgggtttcctgctgatgctgttgcctgaggaatgggatgaaatcaccctgaggttcatcaacagcctgaaggaaaagaagagtgaggagcatgtggatgatgtgactgatcccagcataacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 13686 - DNA, 351 bp, Homo sapiens
cttttcaccttgcactctgagctacctggcaccccaaaactcctcctggtagtggggttgagctcttgtaaggagcctgaggaagaaagaccagtattgggagctcatgtcccagcccctcatgcacagttcacctagactagagccaggaagtttagggagtcccagtgcatggctaggggtgccctgagggcgctgtctgaacctcaggctgtcacagttcatcaatcagccagccatgcacctgtcaggtgtgcctgccaacagcctgccccatctttctcatcctcccagccaaggcagaccactccagagggacctgcacagccccttcctcaagaccaccacagg

SEQ ID NO: 13687 - DNA, 334 bp, Homo sapiens
caacaacatttgtattcactgactgtagcaatcataagtaattctcatccatgtatgagaccttctaagacaaattccccctctcacatcgacagcaagaattcatttctttttaaatctcctagaacagatgtttactgtcaggctgacctttctgccaagtagtgaggttctgggcatttgtggtgatgatgtctgtttctgagctgctgcaatccctccccagacattcaccagctgctcccaaaccattactgattctatccagggcttccctctgggatctcctccatattcaaagcatatattagaacaaatatgaaccaaaaggttt

SEQ ID NO: 13688 - DNA, 465 bp, Homo sapiens
tgaagaaattatctgtgggttaaaagttagctggcaaaatggagacatctgagacatcacaatgcgtttgttagatctgggataatgctatcattttaaagggataatgctatccagaagagaatggctggaatggtgaagaatgtgaaaaatttgacatgacaggtgagtggactgtgagggagatatttcgcctagataagaaaatgtgacattagtggtggtagtaaggatcgttagtattttcacatattttatgctttgtctctggaaggctaagcatgtaacttgcttaggctgaagcaggctttttacccggagaggtgaactattagagcttttattttactctctttaattatgagcattccccacataggatagttaaacatgtaaaacagacccttatgtccagcccccagttttgttgaatcttaacatttctcatgtatgttttagccttaa

SEQ ID NO: 13689 - DNA, 420 bp, Homo sapiens
gtcacctgttgcccttacagtccccgcccatcccaggtctccctcagaccctgcccgagcgcccccgtccttgcccagcgggccgggaagcacctcgggcaggtggaagccggcccaggcacccagcctgcctctgttggtcggttagaaagacagaccccaaacaccagttccaagaccccggagggcggagggcccgcaaaggaaaggagcccaccatgcgcgtctcagaacaagccttgatgtcttagcgcaggatggggcaggcccccggagttcctgcctgcgtggtctttaggaagtttagtctctggcccagttgggccgggacagcccagaccttcactttgcaagactccgctggtgctcggatctctgccctcttcccaggaggggaagaagcttctttcttcctggccc

SEQ ID NO: 13690 - DNA, 504 bp, Homo sapiens
aaagaactaaatttattcttattttgcatttgacaaaatgaactggttgccattaagtttccatagttggcagaggaaagtaaaatagggcaaggttatgttagaaaaccccaactccagaactctctaaagctcccttggtctccctgggaacagcaggattttagctgtcgctgtctcttgctctgcttgaagcaatgatttcaataaccatttgacaataccaaaagatcagggcacggacaacaaggcctcctggagaattactttggtttagctactttagcaactcttgtccttggagtctatttaaattacagaatagcaccaccaccgtttgtcaggctaggcttcatagcaggagctccaggaaaagcatgacttcagatccctgtgcgtatcctgctagtggtgaatgagaacctggcagagctgtgctccctgcgttcttgagtttcggattctggacttggatgccccattatatgggatttgatccaaagt

SEQ ID NO: 13691 - DNA, 365 bp, Homo sapiens
taaaaatttaaacatttgtgtcaattacatattcatgtaggtaataaaaaaatctcactggccaggcgtggtggctcgtgcctgtaattccagcattttgtgagaccaaggcaggagaattacttgagcctaggagtttgagaccagcctgaacaacatggtgaaatcctctgtctacaaaaaatagaaataaaaaaattagccaagtgtggtcccatgcctgtggtcctgggacccatgcctgtggtcccagctacttaggaggctgagatgggaggattgcttgagcccaggaggtcgaggctgcagtgagtcatcatcctgccactgcactccagcctaggtgacaggatgagaaccttaaa

SEQ ID NO: 13692 - DNA, 370 bp, Homo sapiens
aagcaagaaagaaagaatatgtatttaatttgtgtgagaaagggaggtgcaaggttctgtatatctctaatgatctaactttttgcttgcattgctcatatttcctatttactgttactgacttgagcaatgtggtagattattatggtaatctcattatggtagatttgtcagtttctctgtgagttctagcaatttttggttcatatatgttgacagtattttattaggtgtgaataaccttatacttttcatcttcctgttgagctgtacttaggtttatggccttttccattccgaataaatgcttttattttcttggtcttcattgtctgatattaatataattactccagctttgttttgtttg

SEQ ID NO: 13693 - DNA, 324 bp, Homo sapiens
ggtatactaaaaaccctaacctcagcaatatacaattcatccatgtaatcaaaaaccacgtgtatttccaaagctattgaaacaaaaaaaattgttttaattcaaaacagggaaacaataaatgataagaataagaaactgaatagagagcttggaattttttttaaatcaaacaaatcctggagctgaaaaaaaaaagaaattaaaaaaatgcaatagagaacatcacagcagaattgatcatggagaaaaagtacttgtgtacttgaatacaggttatttgaaaaaatatagtcagaagaaaaataaaaaagaaagaaaagg

SEQ ID NO: 13694 - DNA, 351 bp, Homo sapiens
ctcctgcctcagtctcccaagtagctgggattacaggcgcatgccaccacgcccggctactttttgtatgtttagtagagactggattttgccatgttggccaggctggtctcgaactcctgacttcaggtgatcacctgccttggcctcccaaagtgctgggattacaggcatgagccccagtggccggccacgcatttttttttttttttttaatagttggttctttctatgttgcccaggatggcctcgaactcgggctcaagtgatgcttctgttttagcctcctaaatactttggactatgggcatgcctgtcttagatgcacatttttaaaagttttttgaaatt

SEQ ID NO: 13695 - DNA, 359 bp, Homo sapiens
ggactcaagctgttttcctgcctcagccccccatgtcgctgggactacaggtgcacaccaacatgtacaattgactttaaaattagtttttgtagagatggagccatgaactcctggccacaagcattcctcctgcctcaaccttccaataaaggttttaaaaaatgaaaatgtaatgctttatatttgagaaatgtctttaataatttgtcacataataaattgtcatgacaatattagtacttcagattcttcatttacagtagaagagccactgatctagaattatctaaaactactatttttctaaccacctaataattattgaaattaagcaataaagctatcaataataacac

SEQ ID NO: 13696 - DNA, 983 bp, Homo sapiens
gtaactgaaagcaatttaaaagatttccagagacatgggaagtgtcacccaaagatatgagatctgtatgtgatgaaaatgattagtgagggcagactactaataatgatgtgtcagtcaactgagttcagagacagattaaagagatgcaccaagttctattgtttaataattttttttttcccgagactctgtctgtcgcccaggctggagtgcagtagtgccatctcagctcactgcaagctccgcctcctgggttcaaatgattctcctgtctcagcctccctagtagctgggattacaggcatccaccatcatgcctggctaatttttgtatttttgttagagacagggttttcaccatgttggccaggctggtcttgaactcctgacctcaagtgatctgtgggcctcagcctcccaaagtgttgggattacaggcgtgagccactgtgcctggctgggtttttgttttatgtatttttttattattatttttttaatttttaatttaattttattttttgtaggggcaaggctttgccgtgttgcctaagctggtttcgaactcctgaactcaagcaatctgcttgactcagtctcccagagtgctgggattacaggtgtgagccacccaggcctggccatatttatttttgagagaaaggggggtctcgctctgtcacccaggctggaatgcagtggagcaatcatagctcgttgcagcctcaaactcctgggctcaagcaatcctcccacctcgccctcccaagtatcttgaactatagatgctcgccaccacgcccctgttttatttttttattttgtttttccctactttcagggtgatttcatcaacattcttttctaacctttcaattgaattttttatttctgatttcatgtttttaatatccaattaactccttattttggtaatgtttcttttttatagtattccaatcagtcagcattcacttaaa

SEQ ID NO: 13697 - DNA, 764 bp, Homo sapiens
gtaactgaaagcaatttaaaagatttccagagacatgggaagtgtcacccaaagatatgagatctgtatgtgatgaaaatgattagtgagggcagactactaataatgatgtgtcagtcaactgagttcagagacagattaaagagatgcaccaagttctattgtttaataattttttttttcccgagactctgtctgtcgcccaggctggagtgcagtagtgccatctcagctcactgcaagctccgcctcctgggttcaaatgattctcctgtctcagcctccctagtagctgggattacaggcatccaccatcatgcctggctaatttttgtatttttgttagagacagggttttcaccatgttggccaggctggtcttgaactcctgacctcaagtgatctgtgggcctcagcctcccaaagtgttgggattacaggcgtgagccactgtgcctggctgggtttttgttttatgtatttttttattattatttttttaatttttaatttaattttattttttgtaggggcaaggctttgccgtgttgcctaagctggtttcgaactcctgaactcaagcaatctgcttgactcagtctcccagagtgctgggattacaggtgtgagccacccaggcctggccatatttatttttgagagaaaggggggtctcgctctgtcacccaggagttcaaggctgcagcaagctttgattgcgccactgcactccagccttggcgacagactaagacgctgtctca

SEQ ID NO: 13698 - DNA, 487 bp, Homo sapiens
  misc_feature (486)..(486): n is a, c, g, or t
cattgcagccttgacctgagcttaaaatgatcctcccacctcagcccccacaaagtagctggggacttaccaagcatgccatccaccataccctgctaatttttggaagtttttttttgtggagttgggttcttgctatgttgcttaggctgatctcaaactcctgggctcaagtgatcctcctacctcattctcccaaagtgctgggattacaggtgtgagtcactgcacctagcttaaaaagtttaaattgcaaacaaatctccataggcatgaacagggaaatggataatcctttccctttttaagattatcattgtgttggtaaggaaatgaactcttctccaaaagagtcctgatggtagtgtatttgtttgatttataaaggttgacttttttattagctaagtacttcatttgtctactttatctgatcagtagatcaggcatgaatccacttcagattggtaaccctagtgccgaatnt

SEQ ID NO: 13699 - DNA, 466 bp, Homo sapiens
gatatattcacttattatttcctagaacctgtggatattaccttatgtaggaaaagagtgagtattaccttatacgggaaaagtgatgaaggatgttgagaggaactgtttatcctggattatctggatgggataattcttgataatttttgaaatcctaagtgctatcacatgcatacatataagagagagcagagggaatttgagacatacccatgcagaggagacagccatgtgaagatggaggcagagatgggagtgagtctgccacaagccaaggaagcctggggccaccaaaagctggaaggaagaggccccagagcctctcggaggagtgtggctctcttgatgccttgatttaggatttctgacctctagaactatgagagaatacatttctactgttttaacccattatgctggaggttgcagatttttttgtgtgaaaaatcagaccttggtgatg

SEQ ID NO: 13700 - DNA, 383 bp, Homo sapiens
ggcatatacctgctgtggggtcaaagggcaagattcaacaggtgacactaatgaggaaatcataacatttattcaagagaggagaataatattggggattcttcaaaagcaaggagcatcttgtgtctacttatcctgcaaggtccctggaattctcagtatttctgatgaatggagtgtgtgtattggagggatgcatggaagagatggacagcatcttctgcctgccgagtgttgttgagcagtaaatgcatatgatccagaggtgagaatattcacactactctgggacaggcagagaaagcttgctgaaagcgtgacagtttgaaatgtgtgggatcttgcatcatttctcaaggccctactccctgaagtgtcagcac

SEQ ID NO: 13701 - DNA, 482 bp, Homo sapiens
tgtcatgtcttttgatggagcacatgtattcaaggcctttttcctccagattctgtgctttttacattctatgctacaagactgatattttgtctgtttgtaattacccagttgtggtcatttgcattaaatgacatgagaatttagagtagaaatgccattttcaaaaagcgctgggagtcatcatgtcaaagttcattcaactcattgggagttttccctcaagcagcaaccaaaggctgggtgcggtggctcacgctggtaatcccagcactttgggaggccaaggcaggaggatctcttgagcccaggagctcaagaccagcctgaacaacacagtgagaccttgtctctataaaacagtttaaaaattagccaggtgtgttggcacatgcctatagtcccagctacttgggaggctgagacgggagatcactcgagtccaaaagtctgaggctgcagtgagctatgatcgtgccact

SEQ ID NO: 13702 - DNA, 353 bp, Homo sapiens
tttttaatggttttattctcttattagactctaacatcttagtcatataaaaatgctattttcatctacaagctatcagatttctatgtggtatcttgaagatcaataaactgctgtatacattttaaagtacattttctaaatacttagtatgatataaattgtagatttatggcacattagatctaaggctatatccttatctctcaaaacattttaagatttttttcactgttgaagaatacaggcttttagcttgacatgctctgaaaaattatttttaaggccgatttttctatatatttaggtatggtttcatcctttcctcaatatagttgttataaattccaatt

SEQ ID NO: 13703 - DNA, 1215 bp, Homo sapiens
gccccggcccttctcccctcatcacgctccttccaaaccactatgcccacgcacgcacccacccaaacagagcgttttctggtccccgagctcctcccgaccccacccgctcctacggcctccaaccggccccccccaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13704 - DNA, 1485 bp, Homo sapiens
aaggctaggtgacgaggcctgggtgtcgttcccgaccgcgctcgctcccgcaactggaggcacggcagaggaggcagggccgacggcggtgggcggtgcgttgcgcaggctcgggcctcccgctcgccgctgcgttgggaccgcgcagcccggtaactgcgcacggctggcctcccgggagtcctgcgccgtcgctcctcctggacccgggttcccaggacaacgcctcccggaacgcagggagcaggccgaggccgccgcgtgggcctgcagcgcctcgccgctctctcttccccaggcccgcactcccacttgggctccagggccccagggctgacgttccccccagcttagaccctgagtcgttttcccccgtttcccggctgaattaggttcttcttctccacaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13705 - DNA, 502 bp, Homo sapiens
tcgagctgactcttgaggatcccccgtggccagtacagatatgtaggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13706 - DNA, 1626 bp, Homo sapiens
gccccggcccttctcccctcatcacgctccttccaaaccactatgcccacgcacgcacccacccaaacagagcgttttctggtccccgagctcctcccgaccccacccgctcctacggcctccaaccggccccccccaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaaaaaccaacaaaaaacaaaaaaaaaaacaaaaaaaaaggggggggggcgtccaaaaggttcccccgggggggcgccaggttaacggtttaccgaggtttctttgcaccaggggggcccctatgggggggcgggattttaaggctggcgcctgggccgggggtttacaaggtcgggaacggggaaaaccgggcacccggggaacctggggaagggacccttacctccgggggggggaccaatgtggggcccaatttccctaaggggaatttaagcgcctaaggggaaatttttaacaattttaagggggttaatagggggttttaaactatagggcgaaataggcgtgggcggcttgagaaaaatttggcgcaagcggagaatatgaatttgggaaaatttttattcggggtc

SEQ ID NO: 13707 - DNA, 714 bp, Homo sapiens
aaggctaggtgacgaggcctgggtgtcgttcccgaccgcgctcgctcccgcaactggaggcacggcagaggaggcagggccgacggcggtgggcggtgcgttgcgcaggctcgggcctcccgctcgccgctgcgttgggaccgcgcagcccggtaactgcgcacggctggcctcccgggagtcctgcgccgtcgctcctcctggacccgggttcccaggacaacgcctcccggaacgcagggagcaggccgaggccgccgcgtgggcctgcagcgcctcgccgctctctcttccccaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13708 - DNA, 454 bp, Homo sapiens
gccccggcccttctcccctcatcacgctccttccaaaccactatgcccacgcacgcacccacccaaacagagcgttttctggtccccgagctcctcccgaccccacccgctcctacggcctccaaccggccccccccaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13709 - DNA, 1228 bp, Homo sapiens
aaggctaggtgacgaggcctgggtgtcgttcccgaccgcgctcgctcccgcaactggaggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13710 - DNA, 1680 bp, Homo sapiens
aaggctaggtgacgaggcctgggtgtcgttcccgaccgcgctcgctcccgcaactggaggcacggcagaggaggcagggccgacggcggtgggcggtgcgttgcgcaggctcgggcctcccgctcgccgctgcgttgggaccgcgcagcccggtaactgcgcacggctggcctcccgggagtcctgcgccgtcgctcctcctggacccgggttcccaggacaacgcctcccggaacgcagggagcaggccgaggccgccgcgtgggcctgcagcgcctcgccgctctctcttccccaggcccgcactcccacttgggctccagggccccagggctgacgttccccccagcttagaccctgagtcgttttcccccgtttcccggctgaattaggttcttcttctccacaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggtgagtacactggggctgagcaggggcgcatccccatacctcccaaaccccaaggacctagtttcctgaattagagagaggttggtgggaagtgcgtctaagaccaggtctccatggaagccccaaaccctttcctgtttaaaagggtgaccccgcgctctttttcccacgtgttctcccttcctgtgttgacaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13711 - DNA, 1374 bp, Homo sapiens
aaggctaggtgacgaggcctgggtgtcgttcccgaccgcgctcgctcccgcaactggaggcacggcagaggaggcagggccgacggcggtgggcggtgcgttgcgcaggctcgggcctcccgctcgccgctgcgttgggaccgcgcagcccggtaactgcgcacggctggcctcccgggagtcctgcgccgtcgctcctcctggacccgggttcccaggacaacgcctcccggaacgcagggagcaggccgaggccgccgcgtgggcctgcagcgcctcgccgctctctcttccccaggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacatgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaa

SEQ ID NO: 13712 - DNA, 748 bp, Homo sapiens
aaggctaggtgacgaggcctgggtgtcgttcccgaccgcgctcgctcccgcaactggaggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcgtactagagtgccgcgcgtagggctccaggtcgctggcttctgcgctttcttcctctccaaagttgagtatctcctatctgtgtcctcatacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgtggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgtacgcccagaggttgtctggctctgcccactagttgcttgcccctcctttcagccgacgtctt

SEQ ID NO: 13713 - DNA, 1014 bp, Homo sapiens
tatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcatacag

SEQ ID NO: 13714 - DNA, 960 bp, Homo sapiens
tatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaatgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcatacag

SEQ ID NO: 13715 - DNA, 1902 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13716 - DNA, 800 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggaggagtgaccacgctaggtctgaccaagtttgaggctaaaattgggcaaggaaatgaaccaagcatccggatgttccagaaacttcactttgagcaggtaaggatgtcctggggcagagtggggcttagacctgggtggtg

SEQ ID NO: 13717 - DNA, 1395 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacagtgaggagtgcccccccacttcccctagccctggtactgggagggctgactccacagtcagtctccaggttccttccctttcccagccccggccatagaagctttgtgaaaagcctggaaggtgctggaactcctgtattctcatggccctgaagccagtccctgtggctgacccttctgtcctcttccccacccactgcatcgggcttggaaggatttggagaaagtagagcatttggggctctggctgtaaattgaggccctgcccctcatgtccctcaccacagcctagtgtggtgactgccctcctctgtgttccctgctctctgagaatttggttgctggttggagaggctttttctgtatgaggcagatttggaattttgtaatgagctgaaggaagctctgggaccccctcttctcctggcagactcagagatgctggtgttctgcagtgctctggcttgggtaggagtaccatcctctcttctctcctctggggagtgtgtgtgatagccctgtcacctcctcctcagagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcaggtttgtttcacctagccctgccttccgctgactcccggctctcagatctgctgactgagcctgccgaggctgcaaagggtgggcactcacagggttcactgggaggctccatgtggtgagtccagggcctggctgggcagctgcccacctagccccctcagcctggtggtacaccctcagcctcatcactttagtccttatgcttaggcgtgaacttaacccttggtttggggtagattcaagtatggttagtcccatagttggggtgggctggggaccctcagaaaaaggtctctggagcatgttgtcatattacaggaggaggccctcctgtttctgctccttcatggtcctcagtttcccccaagtggctactgactatccccatgaggctagtatactgactccatgaggtaaagaggtc

SEQ ID NO: 13718 - DNA, 859 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcaggtttgtttcacctagccctgccttccgctgactcccggctctcagatctgctgactgagcctgccgaggctgcaaagggtgggcactcacagggttcactgggaggctccatgtggtgagtccagggcctggctgggcagctgcccacctagccccctcagcctggtggtacaccctcagcctcatcactttagtccttatgcttaggcgtgaacttaacccttggtttggggtagattcaagtatggttagtcccatagttggggtgggctggggaccctcagaaaaaggtctctggagcatgttgtcatattacaggaggaggccctcctgtttctgctccttcatggtcctcagtttcccccaagtggctactgactatccccatgaggctagtatactgactccatgaggtaaagaggtc

SEQ ID NO: 13719 - DNA, 933 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagactgctcctccgcactgacccgagacaggataggaaattggacagatagaactgactcgtcctgctgttcttgtgtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcaggtttgtttcacctagccctgccttccgctgactcccggctctcagatctgctgactgagcctgccgaggctgcaaagggtgggcactcacagggttcactgggaggctccatgtggtgagtccagggcctggctgggcagctgcccacctagccccctcagcctggtggtacaccctcagcctcatcactttagtccttatgcttaggcgtgaacttaacccttggtttggggtagattcaagtatggttagtcccatagttggggtgggctggggaccctcagaaaaaggtctctggagcatgttgtcatattacaggaggaggccctcctgtttctgctccttcatggtcctcagtttcccccaagtggctactgactatccccatgaggctagtatactgactccatgaggtaaagaggtc

SEQ ID NO: 13720 - DNA, 1922 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaaaaaaaaatgtcgcgcggccg

SEQ ID NO: 13721 - DNA, 2047 bp, Homo sapiens
atgcggaaggggcggtagccggccgggcctgggaacgtggctggttggaggaggtagatcaccctttctgcgggggacgatttcgtcggtggtagaattttggagtctgtattctttgaagtgtctagacggaactaatgacggaagtcaacttagccccagcaggaaagctggagcgcctacccaaagttggaggaaattcagggtcctgaagtctttgctctccccatctgcatgcaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13722 - DNA, 2068 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggaggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13723 - DNA, 1783 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13724 - DNA, 1844 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaagtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13725 - DNA, 2438 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacagtgaggagtgcccccccacttcccctagccctggtactgggagggctgactccacagtcagtctccaggttccttccctttcccagccccggccatagaagctttgtgaaaagcctggaaggtgctggaactcctgtattctcatggccctgaagccagtccctgtggctgacccttctgtcctcttccccacccactgcatcgggcttggaaggatttggagaaagtagagcatttggggctctggctgtaaattgaggccctgcccctcatgtccctcaccacagcctagtgtggtgactgccctcctctgtgttccctgctctctgagaatttggttgctggttggagaggctttttctgtatgaggcagatttggaattttgtaatgagctgaaggaagctctgggaccccctcttctcctggcagactcagagatgctggtgttctgcagtgctctggcttgggtaggagtaccatcctctcttctctcctctggggagtgtgtgtgatagccctgtcacctcctcctcagagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13726 - DNA, 2092 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagttttccgtttgagggttcctggtgccctaacttcgtgggatctgtccagccgcctttgttgaggttggcttgccatatacatccccttctggaatttgaagaatgtttggtttcagactgctcctccgcactgacccgagacaggataggaaattggacagatagaactgactcgtcctgctgttcttgtgtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13727 - DNA, 2186 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagaatggtaatgatagtagcaacttcagagttgttgagaattaaatgagatggtgtctgccaagtgcccgcactggagcctggcacacggcgtcagcgccgctcctgttgtctctcctagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggaggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13728 - DNA, 1806 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtatctttcccgcttgacatggggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13729 - DNA, 2091 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtatctttcccgcttgacatggggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggaggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13730 - DNA, 1584 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctggcccagcctcacagtgtccactcaaggcagcttgtcctcttgtcctgtcggggtcctctagagc

SEQ ID NO: 13731 - DNA, 1825 bp, Homo sapiens
ctttgaagtcaggttgctgggttgcaagctgtgaggcctttcacacttctttgtgcctgtttcctcgtctgcagaatggtaatgatagtagcaacttcagagttgttgagaattaaatgagatggtgtctgccaagtgcccgcactggagcctggcacacggcgtcagcgccgctcctgttgtctctcctagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggaggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13732 - DNA, 1573 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccagagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13733 - DNA, 1260 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacaagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13734 - DNA, 736 bp, Homo sapiens
atgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacagtgaggagtgcccccccacttcccctagccctggtactgggagggctgactccacagtcagtctccaggttccttccctttcccagccccggccatagaagctttgtgaaaagcctggaaggtgctggaactcctgtattctcatggccctgaagccagtccctgtggctgacccttctgtcctcttccccacccactgcatcggtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 13735 - DNA, 378 bp, Homo sapiens
ggccaaatcattgacttaatagtacctcctaaaatcaaacttcaataaaatctcagtacaactataaaaaatatgtataccatagtattttatagactgtaattggtcataaaacacaaaaagacatagctgctgtgtactggtaatttcatgaaaggggccaaggcgcggtggctcacgcctgtaatcccagcactttgggaggctgaggcgggcggatcatgaggtcaagagatcaagaccatcctggccaacgtggtgaaaccccatctctactaaatacaaaaattagcagggtgtggtagcgcgtgcctgtagtcccagctacttcagaggctgaggcaggagaatcgcctgaacccaagaggtggagtttgc

SEQ ID NO: 13736 - DNA, 707 bp, Homo sapiens
cctcagctaagatgtttcttctttgttctagattcagtcatataagcagaggcagcaggtactaggcctcagagtaatagtccctgaagaaaataaagagaaagtctgtctgagaaaagccagttgtgccagttaaagaatgacctatggccacaatgccttactggagggtgcttgggagcccatgtcctcatgtctgttgtatcgggttagggagatcctggtgcatttcagtggggagggggttgctgctggtcgtgttttcactccttctctctccttccccagtgaccccaagacaaaatgctgttaggtaagtggggtctgcttagccccactaagttcccccatccaccattaggaatcagtggtattgttatagtctaccaggaccgacctggtgctgctcagaaccaggggctcaaggcagggcctcccttcatcttcttaaattattctctagcagctctgagtctcccaaagattggtcctagagaaaagactatgtcatttactgctttttctgatggtaaaaacatgcatatttactgcagaaaatttgaaaaatagagaaatgtgtaaagaagaaaacgtacaaaataactttagactcaaaaccaatctgattaaatcaggaaatcattatttattgagcacctactatgtgccagccactgttgttcttggtgctggggacatagcagtga

SEQ ID NO: 13737 - DNA, 918 bp, Homo sapiens
accaagtctggatatttctccagtatggcacccggatcttcttcctttcgggaacccacctacaggcctgccttgggttctgtcagatactgggcttcctgaagctgtctttgtcctatttacattcataaaagtgagtctgattgtgtcttcctttaagcgcttatccagttacttttgatctgtgaaggcttccttgaccacccaagccccaagctaaacttgtttgcttggctattaggtccactcagttggaacttaaactactcattttcatcactttgtttcaaaatcatgattatctgacattactggggcaaacagggaactgtagataaggtaagggattaacattttttttcctttttaaaaatgttaatcatcttagatggaactttttaaggcagatgacaaaacttacttagcttattaaattgagtgcattactatttaataatgtctggatgaatcaacgtaaatattatgaagataaaatattttatatacaaggcgtaattcagtgaatctacaggttcagcctaatatggtaagtaccctgctactgaaacaacaaaataagacccctgtttgagaaagggaaatatgaaatcagatatatgagttcccctttaagaatggaaactgggttgggtgtggtggtttatacctgtaatcccagtgctttgggaggccaagacaggaggattatttgaggccaggtgttcaacacagcaagaccccatctctacaaaaaataaacgaattagccatgcattgtggcaagcacctgtagtcctacctactcaggaggctgaggcaggacgatcccttgaacccaggagctcaaggttacagtaagctatgagagtaccactgcactccagcctgggcaaaagagtaagaccacatctttaaaaa

SEQ ID NO: 13738 - DNA, 713 bp, Homo sapiens
ctgggggcttttcaatgatctaagagcagcctatgattgtcattctggtctttcctcactgagactttcttcttatttgctgacttttctttccatcaggaaattattctaagagatgttgaaaaatgccattaccatatcctgttattatttttgggtggggggagagatgtggtactaatgtgtgtatgtgtgtgtgtgtgtgtgtgtgtgtgtgtgtgtgttttcagtgcagttgaatctgaaataatgaaaacctagaaccaagtatctaacagaagatgtcctattatggcagggaaggaggagagtcgaggatgttctggccagaggtctttatagggaaagtaccttaaagattttgggggagctatatgaggataaaataactttttctgactaccagttatgtctaaagggatttaaaaaaaaaaagagtgatacttcatattgagattactatgtgccaggcactgggctaagtgctttacagaaattaactcatataattattaccacaatctgatgaggtaaatactgtcattcccctcacttttcagatgaagaaaaagaggcagagagctatttaagtaacttgctgaaggtcacactcttggctggtaccagagctgcgatgtacactcgggttatccaagacaccagccagtgtgcttattccttatgcgaaattttctagaatagacgttctcatg

SEQ ID NO: 13739 - DNA, 574 bp, Homo sapiens
gggaagctcggttatgctgccgcccactcccctctgcccagactggttcaagccgccaccctggactgatgagaatatgccagggataaaccacaactgtgggaaatgctgggtgggggcataaatatcatctgtaaacaattaggcagccactgctcattcagtgccgttttgagaagctaaggaagtccgcaatcagttatatctccaattaccataaaaatatattagccattcattcatttattaatgattcatcagttaaccacacataatgagcaaataattagcagtgctgtacggttgccaaaattgaagaagtgttggcattttaaagatgaaaggttgaatttatgcagaagtctggtgatgataaagttaatatggaagataattataaaagtggctgtcctctattacaggctgaggtaccacaaaacttgcctaattgaactgaaattaatattcttccaaagtctgtgtgttgccacacacaaactgctgaatttctcttgaagatctcccttcagtaaggtgcaccgcacaatacaagttaataaaatgccagacagct

SEQ ID NO: 13740 - DNA, 364 bp, Homo sapiens
ataacaaaaataaatgtttttatttagtaataaatcatttaatattaaatagcttaatcttattaattggatgagaatcttcttttacatttcctttacatttcaactttggaaatatagttgagttttcagattacaccttcatggtgaatacaggagaagatagctaaataaaaattcctgccaagagaagagtagaccttaattttaatcaatttgcatgttgcagaagataaaaagtagagccacaccaagctgaaccagatttaacattatgctttgaagaaacccagtaataatgaattacgcacttatttcataggtccgtcctgcttgttttggctctttagaaacctatatttca

SEQ ID NO: 13741 - DNA, 339 bp, Homo sapiens
tatctgtagtagaaggattctctggatttaaaagcaattgctggtaatagttgtagtcgtacagttttcggtagaagccaaggagtgtacctgtctctcctgtggaaagagatctttttgaagacttcctacagtattagagcttgttttcatgtccatatactccagaactatcaaaattgatggtcttccttaaaagccttttgcatttttatatagttgatttattacacgtagaatcagtaagtgtcaaagagcaaattataggggaaattagaagaatgaaaacacaagaaacgtctaaccagtttaatcaggaaaaaaagagaagatatacat

SEQ ID NO: 13742 - DNA, 453 bp, Homo sapiens
tttcctttaatgataaaatgaatgactttatgatgcttgactgctctgtaaggtgctatataaatgctaagtatttatttgtaaagtatataaacacaaacacacacagccaacatctgctggttttatgtagatgtagtgtgaaaaactgtaaaatttatattcaaattttgaaacatttcccaaattgttacaattacatacttggtcagagtaattcaagttcaataaatctttcagatttctagtattaaaaaaacttttcccccttttgctatagtgttaatttaaaataaatgaccaattacttctaataatgaaactttttttcaaaagcagaagaaaatagcttttgggtatttttaaaaaataatccacattgtatacatacataaatacacacatatacatctattatctttcattttgttatggtacaaacacaatgtaaga

SEQ ID NO: 13743 - DNA, 464 bp, Homo sapiens
agtccatcaaaagccaggttttatgtctttatgaagtattcaggactgtgctgaatactttgtgcaatttctgtcaatgtgtttcatgtctagttgggggaacaaaatacatgtgtttgaaaagatattagatgtttccagatgagtgtgaagttgagctttcgttttagggtccaaaatcaaggatgatcacataggatgttcccagccttcctggggccactggatttatactggttagtgaagtcaggctaagatttttctatccttcaagcccatagaaaaggggcttttctagtagcaacagaatgtgcaagatctggtaaaaatctcaaatattaaaagacaactatgaaattaaaattattaaatgtttaaattcatgcattcaatataatgtatgcctaggatatgccaggcactggtctaggtctgagagatgtcagtgaataaaataaaggaaa

SEQ ID NO: 13744 - DNA, 1188 bp, Homo sapiens
catttgattccatgacctttgttcacaatctccacactatatccagctcctaaaattctgtgaccttgagagtctaagtttctttatttaaccttctcagatatcattgtcctaagaatgtgatattaggctgttgttgaccatggccaataaaagtggggccttgaagccctccctgtggggtggaggctgggcctagtcagggagagacacaggctctctctgacaagcatacacagcctactttttcctccctgctggccgctagccaagggggactcaaggccaaactatctagtagggagattcttccttggacagccttttatctctgcagccaggagcctgggcctttctaggagatcttagaactttattctatcatagcccctgagggttggcagggccaaccctccctcatctgtcctttctcagctggccacacccagaatatctagactggagcacaaaagagaagtagcacttttcccttgatgataacaacagcagcaaccggaactatcatttagtgctttctgtttgtctggaacttttcatttgccctaatcctcaacatataaaaccctatgaattttgttttgcaggcaaggcaattttaccttttggagcctctgttttctcatctgtaagactggataatagctcctaccacacagagtggttgtaaggattaaaagatataacccatgtggaatttttaatgtaccattggcacctggccagttgtcaatcactgtcagcttttcttgttactgtttctagacccccacacagtcatggaacaaccaccaaccaccatcacttgccattcacctcaaccctgtaattgtgttattttggtcttagctgctgttctgggcaccacctcatgtttgacttggatttcaaacttgcagtcaactcaaacctcagttcttgtaacttgttcccaggcattgaaatttctgacctatgtctctggttccttagcactgatatgccctggtgaggacacaggtgtccagcaagccctgccttgtaagggtcacttcagaagtccctggacattaaggattaaatagcatcattatgtattgttattagtttattttctcaagtgacatcaaagtatttttcttcagtatgcagaaataaacagttctgtttgtcctttcccagaaaaaaaaa

SEQ ID NO: 13745 - DNA, 2264 bp, Homo sapiens
caacgccattctcaagcaagcgcatcaatatatttagttccggcctctttgcacgtcatttccggcaccggcatggccgggtgagctgcaggctaccttatttaagaccgggaatttagtcagcctggtgagccgactctgaggagatggagtatcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgaggtgagtcgctgggtggagggtcggggagtcaagtggtcagccgagttggaggctgatttgccccgatcatggcaacggcatggtaatctcttgttgctgagtgaagactgtttccaagccaagcagtggaaaaatctgggaccggaactctgggagaccgttgccttggcacttggcgtccagcgtttggcaaaacgagggcgggtatcaccggatggtactcgaactccagcagtgacactgctgctgggtgaccatggctgggtagagcatgtggataatggtatccgttataagtttgacgtgacccagtgtatgttctcctttggaaacatcactgagaagcttcgagtggcatcgttgtcctgtgctggagaagtgctggtggatctctatgcagggattggttattttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcctgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccaggttgtcatcccttttgtcccctggtgatcagtttttttcatattttatagccctgaaagcaggctctagatcaattcaaattatttcatttgtctttcattgataacagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacagagagaccagtgaggaggcttctgtggttgtccaggtctgaggtgatggtaacttggactcggatggtggtaatgggaggtagattgatatgataaataaaattgacagaccaagcaatggaatcagaattaagtccttaacatgaagctgctttgttattatgactgactaaattagagagagaagggaacaaaaattattttagtgtatttccattcccttactgtggcattcctaaatgattgtgaggggttgtcttataaatttggtttgttgtggtagaaa

SEQ ID NO: 13746 - DNA, 2093 bp, Homo sapiens
caacgccattctcaagcaagcgcatcaatatatttagttccggcctctttgcacgtcatttccggcaccggcatggccgggtgagctgcaggctaccttatttaagaccgggaatttagtcagcctggtgagccgactctgaggagatggagtatcgctgaggtgatgagagagaatgtggttgttagcaacatggagagagaaagtgggaagcccgtggctgttgtcgcagttgtgactgagccttggtttacccagcgatacagagaatatctccagaggcagaaactctttgatacacagcaccgtgtggaaaagatgccggatggctcggtggcgctaccggtgctgggagagacgcttccagagcagcacctgcaggagctgaggaatcgtgttgccccaggcagtccctgtatgctcacgcagctcccggatcctgttccttcgaagagggcccagggttgttcacctgcccaaaaattgtgtcttgaggtgagtcgctgggtggagggtcggggagtcaagtggtcagccgagttggaggctgatttgccccgatcatggcaacggcatggtaatctcttgttgctgagtgaagactgtttccaagccaagcagtggaaaaatctgggaccggaactctgggagaccgttgccttggcacttggcgtccagcgtttggcaaaacgagggcgggtatcaccggatggtactcgaactccagcagtgacactgctgctgggtgaccatggctgggtagagcatgtggataatggtatccgttataagtttgacgtgacccagtgtatgttctcctttggaaacatcactgagaagcttcgagtggcatcgttgtcctgtgctggagaagtgctggtggatctctatgcagggattggttattttacattgcctttcctagttcatgctggtgctgccttcgtccatgcttgtgagtggaatccccatgctgtagttgctctgagaaataaccttgagatcaatggagtagcagatcggtgccaaatacactttggagataacagaaaactgaagctctcaaatattgcagatagggtgatcctggggctgattcccagctctgaagaaggctggcccattgcctgccaagtgttaaggcaggatgctggaggcattttgcatatccaccaaaatgtggaatctttcccagggaagaatcttcaggctcttggagtcagcaaagtagagaaagagcattggctgtatcctcagcaaattaccaccaaccaatggaaaaatggagctaccagggattctaggggaaaaatgctgtcaccagccaccaagccagagtggcaaaggtgggcagaatctgcagaaactcgaatcgccactcttcttcagcaggtgcatgggaaaccatggaagacacaaattctgcacatccaaccagtgaaatcctatgctccccatgtggatcacatagtcctggatctggaatgctgcccctgtccttcagttggctagaggaggtagatcctgggacacatgggatccacgtgcgagtggcccttaaatgtatcagttcagtccaggttgtcatcccttttgtcccctggtgatcagtttttttcatattttatagccctgaaagcaggctctagatcaattcaaattatttcatttgtctttcattgataacagaaaatgaaatacctgtttgggagaagcagcatggcccattgaaatgaggctcatctgtgcaattatgaattccaaattctgacctcagttctggaattgaagtttcagtatgttttggcctcgggtttcgttatttgcaaaatgagagtttctttgaactgtctcacgtgactattaagcaactatacacaggacatcggttattttagagtgaaagacacagtgctttttccaaattgctctggctaccatatagaaaattgactgaaggagggccaagatggaaacagagagaccagtgaggaggcttctgtggttgtccaggtctgaggtgatggtaacttggactcggatggtggtaatgggaggtagattgatatgataaataaaattgacagaccaag

SEQ ID NO: 13747 - DNA, 274 bp, Homo sapiens
gctggccgggccaggtgcgtccttccccagttctaggtggcaaatggggtggggccagagccttctggctagggaagacactggcctggttggtgtggcaggggcagcgaaggagggtcaaaggccactctggcctggaagagtccccagccacctggacgggggtagccaggcctggtccctgcccccactctccaaggggtcggggcagccgggcagagccagtaagtgtttgttttcagatgacatttgtaaagaaaaacagcctcccaca

SEQ ID NO: 13748 - DNA, 781 bp, Homo sapiens
cctattttggctcggctcctgcccagcacctggcggcctttgtaggcctaaagcttcctcaagtcaagcgttccaggcccagatcatgctgcccaggggccttcacaggcccagctactgcctgacgatggcttccccaggcccaggtcttgccttcccccagcctcccgaggcccagcccttgcctcacagttgctttcccagtccacgttacagcctgttacccgacggccttgacagaccaaactcttccttcacactggacagtttaggacaagctcatacgtcttccagcctctccaggtcaagctcctgcctcacactggcctctataggcccaggtgctgaatcgcaatggtctgtttaggtccatctcatgcctttctcagactctccaagcgacgatctggcctgacacttgcttctgtgggccatgtgatcactcacactggcctctttaggatcaggggatgcctctccacaggccgagatcctgcctgttgtaggccccttcaggatgcgccgctgcctgacagtggaccctccaggcctagatgttacgtgatcatggcctctgcaggtcaagaatttaaattttcgcagcctctataggccaggctactgcctcctgataatggcttctgcaggcccaaatcgtcctgaaataagcctcgccaggaacagcgcatgtgtgttggatgcccgaacaaccatagcttctcccgcacagtggcccatgggggccgggctcttgcctcagcctggccacctcaggcccagt

SEQ ID NO: 13749 - DNA, 380 bp, Homo sapiens
taaaattcatacatttcccttacttatatagatcttcctactttccagacatgtgtattattgtatattacatttgtcaatagctcatggcaacagatacacatagtttgggataacccttttatacctcatatgagcagtgttcaaaggtttaaaagcacaactccaaagggcacagcttgaaatggagcgggaggatgctagcaaagccaccccaataaacacaaaatcttagtaaaagcactatgtttaccaggcaatgcaacttcaaaacaaattccttagcaaccccaacctcttcaagcccgcttctaatcacattattactcctaagcctccttatatacaaaatcttaggctggccaagcccaaacacacag

SEQ ID NO: 13750 - DNA, 498 bp, Homo sapiens
cttgggcctaagaactctatcctcttgggattgagattttctggttcaccattgccctgcactgggggtgtgggatgctgttggctgggttccacagctccagctctcaaaggcatgtggggtatcttgagggggtagtggctccggtagggggtggaagccaggagagcagtggcctcacagtgaggagtcaggcaaggacactctctactcattaagggaacatgggtctgatcaaggagttagaacattcctttccaagccagccgggcaaatttctctgctgctcggggtttgggggcagctctcgccctggcatggctggccaacagtacaggcaaagtgataggggagaagtcggtgagcagagccacaggatgtatcttttcctgtgggtttctgggggaggaaggggcacagaaattcttgtttttcagaatggtgttgggaaaagaagtgtggatgtagaagggactggacctactagaacaacttcct

SEQ ID NO: 13751 - DNA, 6054 bp, Homo sapiens
cgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtattacttttttagactcccgtctgcacaaaatgcaataaaaataattttattatacccttaaaaaaaaaa

SEQ ID NO: 13752 - DNA, 6000 bp, Homo sapiens
cgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctacatcagctccgttgttctgtttggggcctgcattgagggggtcgtcctgcgggacaagtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgtatggcttttactgtattacttttttagactcccgtctgcacaaaatgcaataaaaataattttattatacccttaaaaaaaaaa

SEQ ID NO: 13753 - DNA, 4718 bp, Homo sapiens
ggcctggttttcagtatcaggaaattagagaattattttatcaaggaaaaaacaatggaacatttggggctctgctcccctgtcacccttacagaacttagtcctgtggcaggcacacagttggttctgtagttggtatggagacctgccctggaaatccaggcagcactgctcacctggcatctcctgtccacatcattccaggtttggcgaagctgtgaatggcaacctcgtggtgggcactctggcctggccatctccatgggtaattgtcatcggatccttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtattacttttttagactcccgtctgcacaaaatgcaataaaaataattttattatacccttaaaaaaaaaa

SEQ ID NO: 13754 - DNA, 4459 bp, Homo sapiens
cgccgggcgggcgggcactgcagcttcttctccacctgtggggctgggctgcagagcctcacgggggccccacgcctgctgcaggccatctcgagggatggcattgtgcccttcctgcaggtctttggccatggcaaggccaatggagagccgacctgggccctgctcctgactgcctgcatctgcgagattggcatcctcattgcatccctcgacgaggtggcccccatcctctctatgttcttcctgatgtgctacatgtttgtgaatctggcctgtgcagtgcagacgctgctgaggacacccaactggaggccacgctttcgatattaccactggaccctctccttcctgggcatgagcctctgcctggccctcatgttcatctgctcctggtattatgcactggtagccatgctcattgctggactcatctacaagtacattgagtaccgtggggcagagaaggagtggggcgatgggatacgaggtctgtctctcagtgcggctcgctatgccctcttacgcctggaggaagggcccccacacaccaagaactggaggccacagctgctggtgctggtgcgtgtggaccaagaccagaatgtggtgcacccccagctgctctcactgacctcccagctgaaggcagggaagggcctgaccatcgtgggctctgtccttgagggcacctttctggaaaatcatccacaggcccagcgggcagaagagtctatcaggcgcctgatggaggcagagaaggtgaagggcttctgccaggtggtgatctcctccaacttgcgtgatggcgtgtcccatctgatccagtccgggggcctcggggggctgcagcacaacactgtgcttgttggctggccccgcaactggcgccagaaggaagatcatcagacgtggaggaacttcattgagctggtccgggaaaccacagctggccacttagccctgctggtcaccaagaacgtttccatgtttcctgggaaccctgagcgcttctctgagggcagcatcgacgtttggtggattgtgcacgatggaggcatgctcatgctgctgcccttcctgctgcggcaccacaaggtctggcggaagtgcaagatgcgtatcttcactgtggcccagatggatgacaatagcatccagatgaagaaggatctgaccacatttctgtatcatttacgcatcactgcggaggtcgaggtggtggagatgcatgagagcgacatctcagcttacacctatgagaagacgttggtgatggagcagcgttcccagatcctcaaacagatgcatttaaccaagaatgagcgggagcgggagatccagagtatcacagatgagtcacgaggctcaatccggagaaagaatccagccaacacgcggctccgcctgaacgtcccagaagagacggctggtgacagtgaagagaagccagaggaggaggtgcagctgatccacgatcagagtgctccccaactgccccagcagctccccgtccccaggggaggagcctgagggggaaggggagacagatccggagaaggtgcatctcacctggaccaaggacaagtcggtggcagagaagaataagggccccagtcctgtctcctctgagggcatcaaggacttcttcagcatgaagccggagtgggagaacttgaaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttatgtgactagaagcgcaacagacttctcgccatagtcgagctctcccgctgggggcactgcggggaggcgaggcctcgggaagctgaattttccttgacgtccaagagtttgagagcgaaagtgctttaggcccaggcgggggtcgtggcctcgttccctcgacacctccgtcctgctctcgcctcttcgccctttccgcgcgcccttggcttcccaccctcctctccagtccttttccgagatgaggtgagacaagggtccaacttttcctggattcgcctcccagcggacgtgagcttccactgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctcctcgccaaagactgaaattgtggagctggagggcgccccctccccggagtttcctccctgggacaagtgagggaggagggggccgattctggtttaggggccggacccactgagaggccccagagccgcccgtgatgttcctcccccgtccccatctggcagctcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccagggcctttggcttccccagctcatccttggcccttccgctccaccagcctggtctgaggcgtgctctgtccttagagaaggcgcggtggccgggttcccttcccctagggcacattactaagggggtcaggcactgcatgctcgttccagcaccatctgggactgggtacagtacctccagccccagggccctgacctgcgcacctagcttgacatctcacgcacctcccagagctggcgccactgagtaatccggacctcaccacctcttttcctttgagcccaaaggcagagctggagctggcgccacccagacagcgtcaggtgtggctggggtaggtttggaggtctgccagttacaccaagtcccctctgagattcgatcaggggactggatagattctttcaggtactcaatcaggaagctggaggtgttagacaccagccccctgcatccttcagtagacctccctctgaacaccacagccaggtcctgccttctgggggcctgaatattccagagctgatgtgatgggctgtgcagaagggggctgtatcaacatcaattagggaaccaaagttgcactatctgggcccagattgtctggttggcaagagcaaagtttccgttgatgaaacagacatcccacaacaaaaacccaagttttctgtgctacatgtgcaatatttgttatgaatgttatcacaagtcattcatcaagttatctttataatcactgtagttagatgtttcatgtccattcaagtgacttttattctgagtgcaatatttcaatagccttgtagtgataactagtgttgcttttgttttagatgatctatgtgcagggcaatgcaatgaagttgaaaacccttgtaaataggagaggttgcaaaccaaatcaagagtatttattactattactgctattattattaggcctgcctttaattttcagtgtaagtgttcagtatgccgcatcctgcctcagtattgatcttgtgttctttgtgccaatatgaaaaggagagggttggttctttcctttattgttgaatgctcccatttaatgctttatggcttttactgtattacttttttagactcccgtctgcacaaaatgcaataaaaataattttattatacccttaaaaaaaaaa

SEQ ID NO: 13755 - DNA, 1615 bp, Homo sapiens
cgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtgatggcaaccccaaggaaagcagtcccttcatcaacagcaccgacacagagaagggaaaggagtatgatggcaagaacatggccttgtttgaggaggagatggacaccagccctatggtgtcctccttgctcagtggcctggccaactacaccaacctgccccagggaagtagggagcatgaagaggcagaaaacaatgagggtggaaaaaagaagccggtgcaggccccacgcatgggcaccttcatgggcgtgtacctgccgtgcctgcagaacatctttggcgtcatcctcttcctgcggctcacctgggtggtgggcattgcaggcatcatggagtccttctgcatggtgttcatctgctgctcctgtacgatgctcacggccatctccatgagtgcaattgcaacgaatggtgttgtgcctgctggtggctcctactacatgatttccaggtctctgggcccagagtttgggggtgccgtgggcctctgcttctacctgggcactacctttgcaggagccatgtacatcctgggcaccatcgaaatcctgctggcttacctcttcccagccatggccatcttcaaggcagaagatgccagtggggaggcagcagccatgctgaacaacatgcgtgtttacggcacctgtgtgctcacctgcatggccactgtggtgtttgtgggtgtcaagtatgtcaacaagtttgcccttgtcttcctgggttgtgtcatcctctccatcctggccatctatgctggggtcatcaagtctgccttcgacccacccaacttcccgatctgcctcctgggtaaccgcacgctgtctcgccatggctttgatgtctgtgccaagctggcttgggaaggaaatgagacggtgaccacacggctatggggccttttctgctcctctcgcttcctcaacgccacctgtgatgaatacttcacccgaaacaatgtcacagagatccagggcatccctggtgctgccagtggcctcatcaaagagaacctctggagctcctacctgaccaagggcgtgattgtggagaggagtgggatgacctcggtgggcctggccgatggcactcctatcgacatggaccacccttatgtcttcagtgatatgacctcctacttcaccctgctggttggcatctacttcccctcagtcacagggatcatggctggttctaaccgctctggggacctgagggatgcccagaagtcaatccccactggcaccatcctggccatcgccaccacctctgctgtctgtatcctgcacagctgtgctgggaccaccctcgggggagggcaagagggagggcagctgaacttgctgccttacctgctggtgcaggaagggtggggagggggaggactgaaccgtggggattctcctttatc

SEQ ID NO: 13756 - DNA, 336 bp, Homo sapiens
aaccagtccaacgtgcggcgcatgcacacggccgtgcggctgaacgaggtcatcgtgaagaaatcccgggacgccaagcttgttttgctcaacatgcctgggcctccccgcaaccgcaatggtgatgaaaactgtatcctggaattaaaattgggggaaagagggaggtggacgtcagggaatctgggtcctgtccctgggatggaagagctgagctgttcctgcctccggatcagcacctcggacagggacacgggcgcgagaggtcccctggcagccgagcgcgaccccaatttcgtcgggagggaaggagaccgggtctttctccttgaccgg

SEQ ID NO: 13757 - DNA, 389 bp, Homo sapiens
attcgagggactcccttctgtcagcatgaagcttatcataattaacaaactctgctcttccagatttaaaatcaagatgaaattaatgtttcccttagaaatgcgtgctgtggtccaggcacggtggctcatgcctataatcccagcactatgggaggctgaggcggctggatcacaaggtcagcagttcaagaccatactggccaacatggtgaaaccccatctctactaaaagtacaaaaattagcttggtgtggtggtgcatgcctataatcccagctacttgggagggtgagggatgagagtcacttgaacccaagaggtggaggttgcagtgagctgagattgtgccactgcacttcagcctggtgacagaacaagactctgtc

SEQ ID NO: 13758 - DNA, 816 bp, Homo sapiens
  misc_feature (477)..(477): n is a, c, g, or t
  misc_feature (480)..(480): n is a, c, g, or t
  misc_feature (509)..(509): n is a, c, g, or t
  misc_feature (519)..(519): n is a, c, g, or t
gatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaanggggaaaaaaaaaaaaaaaaaaaaaaaanaaaaattggnggcccctttgccccaatttttttttaacctggaaaagttttttgtggggggcccaattaggggccctttggccaattccccctttaggggggggaataaaaaatcactgggcccgttttataaaagcgggggttgagaaaaccccgggggtcccaaaatttaacgctttggacaacaccccctttgcgaggtggggaaaaaaaaaaggcccccacctttcccttttccaaaaatgtccacctgtatggggaaggaaaattgacgcttatttttttgtaaaacccgctatatttgtgt

SEQ ID NO: 13759 - DNA, 486 bp, Homo sapiens
aaacattaatttcaaacacatgaataacattattgttttatttaacccaatattcagtgatccctgactgggttgggctcagtaacatgtctttcaaaaacaaaaaaaatactagactcatatatattttttgagtaaagctgctggctttgtctccatacttccactctgttctcttgactcagttctcaattcagggccaaagtcaagagcaaaactgaacctgtaggctagtccttggtaaaagtaaggcaaaatggcaactgacttggcaatctctcccaatttggggatgccctggacacagtaagcagagtcaaatgtaaactacgtcctaagaaaatggcaatttctgtagtctcaggtcatgaaaatacatttttaaaaactaattgtctgttaaaattattttagttgtgaaatgttaacaatatcaggataaggagttagacaaaaaatcttggacataatttccagttttttcct

SEQ ID NO: 13760 - DNA, 361 bp, Homo sapiens
tgtgtgtgtgtgtgtgtgttttaattgccagaagtctttcagatagcagggagattattggaatgagaaagcaaagcttgtatgaaaacttgtggcaaaaggtcatctgtgctgtgggggaaatttcaaagtaggcgcagtttgtttccagtggttcctgcctgtcctttcagtggctggtcactctctgttccctttccagacgaatctttcccctcttccaaatgcctcacatcagtctaggtaccttggttggcctgtggagaaaaacagtcttgttgagacactcacattaagctgatagagaccttggctaggataattgcatttttcaaaggctaagggttggaaggatttaatt

SEQ ID NO: 13761 - DNA, 381 bp, Homo sapiens
aaaaaccccacacacagttccttcatctttgccttacttgctgaagattagaagtcccagggaatccaaccttattttatctttgaaaatatcctgaagtgccaaataaaccaacagtctgaagcgggggaagactctagccccagcaatacctgcgactactaatgaaaaagacttgacggactgaaactgcccgagatttctcacataatgtcatcattacgtggatgtgcttcagtgctctgaaataatggcactttaatctcaagtccacctgccaccatctgaaaaggggggaaaaaagccaaagatataaaatactgaagaaaggtgagggtactgcttcattacccatacaatacagttttatttcagtgctac

SEQ ID NO: 13762 - DNA, 1210 bp, Homo sapiens
cacctcagcctcccaaagtgctgggattacaggcatgagccaccgcgcctggcctcattttgtttttgttttgagacattcttactctgtcacccaggctggagtgcagtggtatgatctcggctcactgcaacctccacctcccaggctcaagggatcctcccaactcagcctcccaagtagctgggactacaggtacatgccaccacacctggctgattttctgtatttttagtagaggtggggtttcaccatgttgcccaggctggtcttgaactcctgagctcaagtgatccacctgccttggcctcccgaagtgctgggattacaggcgtgagccaccatgcccagccgaatgattcattttcaactgctgtctctgtgtagctgacttcttccatatttttctataagattttacaattaaattcttcctgatttaaatcttgttaccttgtctctatggttctaaaattaaatgcatcatcttctgtcataagccatatcccaatacccatctcgtgtattaatcccatcaatcattcaggtgtctggaatacaattctttagagtcatttaaaattacatggtccttttataagatctaatttttcacttaaaagctctttctgtttgatttttgtttccatctccattaccctcattctggtctcgggtcttactcatttatatgtttatgtctctgtaatacatccaaccaggttttcctaccgtcatatcccctctaaagtgtagtctaaaccaagacatgacgtacaaaaccataatgtgcaggtcttcctttagcttctttttcattatattactccctaaccccagatccttcattgatttcctcattgcagattactttggcaactgtctttactgtgtgaatcagttttctcattcatgttttttaacatacagtaaaatgcacagttcttaagggtttagttcagtgagtttttgacaatagcatacgttcatgtaattacaaaatctaaacatttgtattcctaccccctcaagagtttcataggttagttttgcttgttttagaactttatataaatggaattattgaatgtacaatttttgtatctggcttctttcattctgcataatgtctactgtaatctgtggtttattccttcttattactgaatagtattccattggatgaattatatcataatttgtttatcca

SEQ ID NO: 13763 - DNA, 1156 bp, Homo sapiens
cacctcagcctcccaaagtgctgggattacaggcatgagccaccgcgcctggcctcattttgtttttgttttgagacattcttactctgtcacccaggctggagtgcagtggtatgatctcggctcactgcaacctccacctcccaggctcaagggatcctcccaactcagcctcccaagtagctgggactacaggtacatgccaccacacctggctgattttctgtatttttagtagaggtggggtttcaccatgttgcccaggctggtcttgaactcctgagctcaagtgatccacctgccttggcctcccgaagtgctgggattacaggcgtgagccaccatgcccagccgaatgattcattttcaactgctgtctctgtgtagctgacttcttccatatttttctataagattttacaattaaattcttcctgatttaaatcttgttaccttgtctctatggttctaaaattaaatgcatcatcttctgtcataagccatatcccaatacccatctcgtgtattaatcccatcaatcattcaggtgtctggaatacaattctttagagtcatttaaaattacatggtccttttataagatctaatttttcacttaaaagctctttctgtttgatttttgtttccatctccattaccctcattctggtctcgggtcttactcatttatatgtttatgtctctgtaatacatccaaccaggttttcctaccgtcatatcccctctaaagtgtagtctaaaccaagacatgacgtacaaacccagatccttcattgatttcctcattgcagattactttggcaactgtctttactgtgtgaatcagttttctcattcatgttttttaacatacagtaaaatgcacagttcttaagggtttagttcagtgagtttttgacaatagcatacgttcatgtaattacaaaatctaaacatttgtattcctaccccctcaagagtttcataggttagttttgcttgttttagaactttatataaatggaattattgaatgtacaatttttgtatctggcttctttcattctgcataatgtctactgtaatctgtggtttattccttcttattactgaatagtattccattggatgaattatatcataatttgtttatcca

SEQ ID NO: 13764 - DNA, 463 bp, Homo sapiens
aattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataac

SEQ ID NO: 13765 - DNA, 829 bp, Homo sapiens
taagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggagtaactgagcctgggggcttggggagccacatttggacgagatgcctgaacaaaccaggggtcttagtgatggctgaggaatgtgtctcaggagcggtgtctgtaggactgcaagatcgctgcacagcagcgaatcgtgaaatattttctttagaattatgaggtgcgctgtgtgtcaacctgcatcttaaattctttattggctggaaagagaactgtcggagtgggtgaatccagccaggagggacgcgtagccccggtcttgatgagagcagggttgggggcaggggtagcccagaaacggtggctgccgtcctgacaggggcttagggaggctccaggacctcagtgccttgaagctggtttccatgagaaaaggattgtttatcttaggaggcatgcttactgttaaaagacaggatatgtttgaagtggcttctgagaaaaatggttaagaaaattatgacttaaaaatgtgagagattttcaagtatattaatttttttaactgtccaagtatttgaaattcttatcatttgattaacacccatgagtgatatgtgtctggaattgaggccaaagcaagctcagctaagaaatactagcacagtgctgtcgg

SEQ ID NO: 13766 - DNA, 709 bp, Homo sapiens
taagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggatgcacagcagcgaatcgtgaaatattttctttagaattatgaggtgcgctgtgtgtcaacctgcatcttaaattctttattggctggaaagagaactgtcggagtgggtgaatccagccaggagggacgcgtagccccggtcttgatgagagcagggttgggggcaggggtagcccagaaacggtggctgccgtcctgacaggggcttagggaggctccaggacctcagtgccttgaagctggtttccatgagaaaaggattgtttatcttaggaggcatgcttactgttaaaagacaggatatgtttgaagtggcttctgagaaaaatggttaagaaaattatgacttaaaaatgtgagagattttcaagtatattaatttttttaactgtccaagtatttgaaattcttatcatttgattaacacccatgagtgatatgtgtctggaattgaggccaaagcaagctcagctaagaaatactagcacagtgctgtcgg

SEQ ID NO: 13767 - DNA, 429 bp, Homo sapiens
ggttaagttatatgctctatatcagccagtgttcctttagtatctattctgtgccaagtattgtccagagctcaacccataatagaaattctccctatatacccacgtgtctcttaaatgacagagaaatcccgaaaatgcattatattaaaaacagtgtggtggtagtttcccagaaagaggacataggccaatttaagagcacgaaagctttgataatctgccctgccagttgtaaacccttaggtgtgtggaaaaaacagtagagactaatcacagaaggagtaaagcttagaaacaatggctgtaggccaggtgtggtagctcacacctgtaatcaagcactttgggaggccaaggcatgggggttgcttgagcccaggagtttaagaccagtctgggcaacataatgacaccctgttcctacag

SEQ ID NO: 13768 - DNA, 540 bp, Homo sapiens
cagcttctttttgtctctcccccctcccctcccccaacagctgcgtccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttc

SEQ ID NO: 13769 - DNA, 766 bp, Homo sapiens
agcgggggggcgggggcgggcagctttgttcgcgccgggcgcccgcgtcgccggtgtccgcgagccgcggcggggccggctgggctgctcgcatcacttggcgcccggcgcggcgagcgctacccgcggcccccgcgcggccctccccacaaagggccgcggagctgcgtggccgccgccgccggccgtggctcgcctccgcgggcgcggaaatttgttgcacttcttggggctttgtttatttgtttgttttttctctgggtttcttatttttttcgttattttggacaaaatgtcggtccgtgatataaaaattgagcgaggaaccttggtggcatgggagctttgcagaagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagtgctgggcctaaaggagataacatttatgaatggagatcaactatacttggtccaccgggttctgtatatgaaggtggtgtgttttttctggatatcacattttcatcagattatccatttaagccaccaaaggttactttc

SEQ ID NO: 13770 - DNA, 546 bp, Homo sapiens
  misc_feature (346)..(346): n is a, c, g, or t
  misc_feature (418)..(418): n is a, c, g, or t
  misc_feature (454)..(454): n is a, c, g, or t
  misc_feature (510)..(510): n is a, c, g, or t
  misc_feature (521)..(521): n is a, c, g, or t
aattcgcggccgcgtcgacggcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagaagaatgantttgttgttttggtttcaaattgtggaaaataccaagagattgatgtatgtctggatatgtgtgcagcagangagacaactttgcttctttacagctttgcaagtgcntaaacaaaaatgtagaagtgaactagatatgggagtactttttagcatagtatacntgtggatttangatatactggatttgtgctcggatt

SEQ ID NO: 13771 - DNA, 583 bp, Homo sapiens
  misc_feature (409)..(409): n is a, c, g, or t
cagcttctttttgtctctcccccctcccctcccccaacagctgcgtccatttccttaaggaagggtttttttctctctccctcccccacaccgtagcggcgcgcgagcgggccgggcgggcggccgagttttccaagagataacttcaccaagatgtccagtgataggcaaaggtccgatgatgagagccccagcaccagcagtggcagttcagatgcggaccagcgagacccagccgctccagagcctgaagaacaagaggaaagaaaaccttctgccacccagcagaagaaaaacaccaaactctctagcaaaaccactgctaagttatccactagtgctaaaagaattcagaaggagctagctgaaataacccttgatcctcctcctaattgcagagggtgtcctngtcctctcctagtcaccacttgtgcaaacagcgaaagtttagaaaggaaaatcagcaagtcttgcatagagtgtaaggacattcagattgagaatgaagaacttgtcctttcagtctcttcttccctatcaatatgagataaaaacataataaaatcacttgtaaatctaaaaa

SEQ ID NO: 13772 - DNA, 1857 bp, Homo sapiens
ggctggtctcgagctcctgacctcaggggatccacccgccttggtctcccaaagtgctgggattataggcgtgagccaccgtgcctggcccagaatgtttttttaaatcagatgtagcatcttcataaggtaaagcctgtcacatcagagtaacaaagctcctggagtacagtgatgctagagtagaatgttccagaagtctggccatagccccagcttctgaattacctgggagagacaagatgctcaggttactattttttctttattctgatagtacagcctctactcagagaccacggtgtgtgtcacacaaccgaggcagctagggcatattctgagggcttttttttttttttggtttccttaatgattctttaacagagtaactggattggccaaggtctgattcaagaggctgtgaggagagtagagaacaaatagactttgcctctcagagttcagagctttaagttgtataagcatggtccatgtccacctcttgtagacacttattccttaaaagtttccatcatgaaaaataatatcatgtcaaaattttataagcacccagaatgtcccagtagtcaaatgtagtgtctttctccagtctctgttttcgataataaataccttgctctcaatttaggatgatcgtaaagcctatgttcatgctgtgagtcattgtctcccacagcttttgaaacatcgttctttgtcttttctatacaacacctgattctttgtgcctcagactcattgctatcaggaagagactttgccaagatccaccaccacatttggccagtagtgtatacacattaaagtgagagctgatgaaatcacaatgctctattttgttccgacaatcagtatgaaggggtaggtcccagtttgccaatgagcaacagcctctgtatgctggtgtccaagacttacacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgttgaatcaagttactttcctcatcctcagagactttgacaattcagagctcacagatggcagggggaattctcaggcttcccttcctcctgattgacactttttaaaggaagtgatgtggaagttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagtaacctcttctgaagtaactggttaaattaataactggtcccataagtcagggtcaagccacatttataacccattcgggccggccatgaagggttctgactcgacattggtatttaaatgctgttactttcccaatgcttagtagcacttgagactttatttccatcgacaaaaaccaagaaggccacagaagtagcctaacagtcctccctggtcatactcgtttcaaacaggtctgcctgtctagacatattcaggcaggaggttgcttgctgctatcttgaaaaccactggaagattcagcttcttggggacctcagagcccatattcatatggaagcccacccatataagcctcacagagcaaatcacagcaatgttgaagttgttattttcaagtgcttatttcacgacattaaaaaaaatattttttcctggtgtattaaaattaaaaataaaatcataacttttgatttaaaatcaaaaaatg

SEQ ID NO: 13773 - DNA, 306 bp, Homo sapiens
gacagagcaagactgtgtctcaaaaagaaagaaagaaaggccaacaacacacaagaaatgaccagaaagggtactgacctacaaaatttagaatgtatgcctgcccatgaataatcgtagtccaaacagaacctctttaagttcagaaacagcaacccagagcaggcctctaacaacactgtctactaactcagaaagcctaccctcctctacttttaaagttaaagagggattgcgaaggatatttgttatcaaggccaagagctagccttaatttttttagggcagcttgaaataagctaacaa

SEQ ID NO: 13774 - DNA, 500 bp, Homo sapiens
aaatactaccacaccacataacatttcaccccaaattcttaaattttttaacctttatgatccatttaggagtgtatctgtttttatgaatttattcataatcttgtctccattaaaagacaccattgctcatttgcttaatcctcttgaatatcaaagcctctagtcaaagctcttgtgtcattcagctcactttcacttgaatattctataatagaaaacttttttaaagcaaggtgacctgaactaccatttgttccaaataaagttcattattggtttttaagtaacatcttttgacttataccaaggcactaaacatttcagaatggtttagtttttaaagcactttgccaaaggtttagagtattatcttctattaaacattgattcttctgttcagtgtcttgtagcatatgagtacctagggtgtactcattttctatagaaattggtgttccctaactcactattttctatttctctacaatgagttcttt

SEQ ID NO: 13775 - DNA, 426 bp, Homo sapiens
gttcttaggcaaatcatttaagctttctaggcctcagtttccttttcaataaggcaaaaattttggatgagatcagcctcctcaaagtttattcttagaaacatcatctttcaagatttttaattaaagtaattatgtatggccgagcacagtggctcacacctgtaatcccagcactttgggaggctgaggtgggcagatcacttgaggtcaggagttcgagaccagcctggtcaagatggcaaaaccccatctctagtaaaaatataaaaattagccaaacaaggtggtggtgcgtgcctgtaatcccggttactggggtggctgaggcatgagaatcacttgaaccccagaggtagaggctgcagtgagccaagattatgccactgccctccagcctgggtgacagagcgagactttgtctca

SEQ ID NO: 13776 - DNA, 308 bp, Homo sapiens
gcctgggcgatggagtgaaagtctgtctctaataaataaataaataaataaattttgagtcagtagtagtgcaagatttttctagagccagatttcatgcagtaagagcttattttagcagtatgggtttcccctgtcacaccaagccagagccctctgaaccagttgttcttggtacacaggtagcaatgaactagaaaattcccctaatctacctgtggtctgatagaatttgaagagggtaattctgtttgttgccaaactcccatataccaggatgtgccaccacaccattttccataggccat

SEQ ID NO: 13777 - DNA, 416 bp, Homo sapiens
tgattcctaaataaagggtggacaagagcaggtgctccaggccggagtggggccctcagagacgcaggtgcaggcagaaggctcccagcctgcgtaccactgtctcatgcacctggagccctgtgagctcatgctcgttgattgagcaagtgaataacagccatctgctggtcaccattccgtcttttcagtggcttggcaaggccaggtgagagacacaggcataatatacctccctcatggcattgttagccattttgagtgagaccagttcataaagcaaatatgcgcatgtacgtcctcaaccatggtagccgctgtgttttaggacaaggatgaaatggctgctagggggccgtggaggtggcgacgagacctccagtcctcttcctggcacctagaacctctgcgtccca

SEQ ID NO: 13778 - DNA, 849 bp, Homo sapiens
cacaggtacaactacatctagaatgtgtgcaaaaatgtttgcctgctgaagggaatataaattggcacaaccattttggaaaaccatttggccatagccactaaagccgaatatacctatttccttatgacccagcaatcctccttctaggaaaatacctgacagaagtacgttcgtatgtccaccaaaagacttgtgcaagaatgttcagagtagcactgtctgtaatagccccaaaccagaagccacctcaagtgcccatcaacaacataaaggatacataaatcatggtacacccacacaactgaatcttcccacagcaaggaaaatgaacaacctacaactaaatgcaacaatacggatgcatctcagaaatgtaatgttgagcaaaaggtcagagataaaagaacaaggttccgtgtctataaagttcagaaacaggcaaaactcatctatgctgttgagaaagttcaggatgatggttgcccttggggtgagggcaccgaaaggggcaaaaggggccttctaggggctggtgaggttctgcttcgtgatccagtgttacgtgagtgtgttcgctctgtgtaatccatcaagctgtacactcaggattcacacactcctctgtgtgcccatgacgctttaataaaaagcttacactaaatcagtgtgtgctcatgtttgcacggacattatatcacaggtgtataagcatatgagctttggggtagaagggccgtgtccatttgcaggtctgcgctccagggatttgtgagacaagtgtgtacaaagcgtcacacatctataaggtgggcctgggtaagggcatcccacacacattgccataga

SEQ ID NO: 13779 - DNA, 577 bp, Homo sapiens
tgcctgccctaggatgtccagggcccccatattctttcctccctctccaatgacagtctgttccaaaaaaaagctctcataaatttcatttatactgaggttcacatgactgataagatggtatggcccttctctaggacatctgtattttaactactcataacaaggtttaacttacaggaaagactttctaagggtggaatttctaggactgtggctgacagtgaaaatggagttctgtggagtaggaggtcattctgaaagcctaatttgaatcacatggcagtctgtagcagtaaaaagctccaggaattggccaggtacactggttcatgtctgtaaacctagcactttgggaggataccttgagcccaggagttcaagaccagcctgggtaacacggtgagaccttgtctctacaaaaaattctagccaggtgtggtggcacacacccatggtcccagctacttgggaggctgaggtaggagcatcacttgagcctaggaggtcaagtctgcagggagcaatgtttgcaccactgcacttcttcctgggcaacagagtgagaccctgcctc

SEQ ID NO: 13780 - DNA, 478 bp, Homo sapiens
cttactgtaacctttaacttgcaggagaatcactagaacctgggaggcagaggttgcagtgagctgagaccgcaccaccgcactccagcctgagtgacagggtgagactccatctcaaaaaaaaaaggaaaaatttacttgataattttgtaatactgatcactctgtataggcagggcattggttccaggactcccctcctcctacaccaaaatccatgtatactaaaggcctgcagtcatcctacacaacccacatctagtcagccctccccgtgtgcaggttctgcatcccataattttgatctgcgtttggttgaaacaatcctcgtgtacatggtcccagctggttcaagcctgtgttgttcaagggtcaaccgtagttgaaacaaatagaaaaatgaaaattttaatttttttaagctctctactgaaagtaatagtcttgtgagcctaaattatttatcattttgcaactt

SEQ ID NO: 13781 - DNA, 443 bp, Homo sapiens
ctgatggttgccgctgactctactcctccagcctttccacttcatacctcctactaaatccctctgatcttggcagatctagagagttttctgtttcctgtattgaaccgtgactgacacaggaaacaagcctgcttggttgcctcatgcctgaggtctggattagtgtgggcatggagtagtgtagactctgcaggtgtttagatggctgtcctcagctgtgggtagttttggggtgggggaatgagtccaatccaggagaggtcgtcaacaatccccaaccaggaggctgaagggacaaacattctggatggctctcatgctgcctctttcaccatgaggcctcactgcttctttttctgactttcaaaccaaaggaggaaaaacagcaactttttagagtgtttaggcaaaaatttttgctaaggctcaatgactgacta

SEQ ID NO: 13782 - DNA, 808 bp, Homo sapiens
acatatagcccctttccactgctcagtgtcggtgatgtgactcagaagggccacattttcgctgggtcccatctaaaggcctgacactgcagtgaagggcatgctaagtctaggcacaggtcctggcagcaggaaggagacagagcctctcccaggcacacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13783 - DNA, 2200 bp, Homo sapiens
  misc_feature (11)..(11): n is a, c, g, or t
actttttcccnagctgagaagtttccttgcggccagccatcatccttcgtgctgcaccctaagtctacatgggaatgggtggttgagcaagtggcagaaggggttctaagatgccctgccctgccaatccacaccagggggtctgagctccatagcctgagagaagcctggggatatgtggctgggccctggattctttgcttactccagccctttagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13784 - DNA, 1871 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggtaaggtccagggtttaggggatagaggcccaccacctgactacctacaaatcctggatccctctttcttatctgccgcttgccaggggattgaagtcagaattctaaatcagaagagcagaccattgcaggcatcctgaaggcagcttagatccctcgggccagttgctgtccttttggagctttgctctccagatatgagaactgggcctagtgttgctaaccgtggctcaggcacttctgtcagcagaggagccctggctctctcaccttggtttcaccttggcccacagctccacaagcacttatgtgcctggccttctcttctcccctggcccctccaggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggtgagaggcacacattgggctgagggcatagcatgggatggtaaatctggaggagaaggcacagaggcacggaggcctcaagtatggggggacaggatggggagccctctggctccaagggctcctgcagagtctcagcactcactgtctctggcaggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgc

SEQ ID NO: 13785 - DNA, 846 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagagccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactggccaactgcagggggcccctcgggcctcacttgccctgagcccaggagtccaagggcagggtgggtccagccttgagcccctccagccacaaatccttcctctcctcccagttccacaacccttggcacacggagtcctggggacgccagtgccatcagctgcggaagacgggcgcggatcagaggcactggttcccatccattgtcaccccgcagatatcctatgagcgagcattgcgtgacatttgagcacggtcatagcctaattgatcgtcggccatcagcgttgaagcataccttacgagaccaacgaagagtccatcgattgatacaaccctctagcactgttagttacacccgtgttcatacataggtatcccgcaccgtgcatccttgaccgaagacagcgagacgacacgccatcgaaagcggctttagacaatagacggcaaaagctaaggaacactccttacggacacaacaagggccatacacccgcccaccgtcagccgatacgaga

SEQ ID NO: 13786 - DNA, 4743 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13787 - DNA, 4900 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggtgagaggcacacattgggctgagggcatagcatgggatggtaaatctggaggagaaggcacagaggcacggaggcctcaagtatggggggacaggatggggagccctctggctccaagggctcctgcagagtctcagcactcactgtctctggcaggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13788 - DNA, 4696 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatgggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13789 - DNA, 4707 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13790 - DNA, 4093 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgc

SEQ ID NO: 13791 - DNA, 4423 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgcctggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13792 - DNA, 3195 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggatgggacccagcgaaaatgtggcccttctgagtcacatcaccgacactgagcagtggaaaggggctatatgtgtatgaatagaccacattgaaggagcacaatgccctcctgtgttgatgc

SEQ ID NO: 13793 - DNA, 479 bp, Homo sapiens
gggggccccctggatgcacttatccaaggcctgaaagaggtaagggtcttggggtcaaggctagtgattgtagagtaatcaatctgcggggagagagtcctctcagccttggccagcttgcacttcctggcatgtccagcaggcggcggtgctggctctgctgcagcctgagctggggcagaatccaggtgaagctggccttctgtagggtccagcctcctgaccgtcttctccctctcagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgaggtgcaacggtgcaggtgacctttctgcttagtggccccacctctgctccagtcacccagtattccccacttccaactcctgactctgggcac

SEQ ID NO: 13794 - DNA, 393 bp, Homo sapiens
ccggccctggctgacttccaccaggccttctccgttgtcttcctggattcctcaggccatctcaacctctgtgctgatgtcactgcctctacttaccaccaggtaccaatgggcccccaatctgtgttcccctgatgtctcagcccagactctgtcccttttgcaagtaccagaaccccagaaactcctcttcaaagagttaagtttagggcatgtctcctggtctaagcccttggatcaatgaagggcacagggatggtcccttctgtggctccaggtacagcatgaggcacggctgtctatgatgttgctggacagcagagctgacgacgggttccacctgctgttgatgactcccaaacccatgatccgggcttttgaccatgtcctgca

SEQ ID NO: 13795 - DNA, 4940 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgtattcctggcctgtctgcccctttcacataattttaacctggtttcttgtatgtaaactccttgagggcaagaacatgtttgaacatagacttcttcgtgtccttcctagcacctattacagtgctttgctcaggggccatccagcacaggcagatggggggcagagaagcccactggaagattgcagagtaaaggga

SEQ ID NO: 13796 - DNA, 4489 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctcctcctccgtggtcttcgggtcgtttgggatcctctag

SEQ ID NO: 13797 - DNA, 1806 bp, Homo sapiens
  misc_feature (16)..(16): n is a, c, g, or t
  misc_feature (20)..(20): n is a, c, g, or t
ccaggctggtccgccncgangtttggatatgtcgaccacgcgcctcgatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggctcatgcttgtaatcccaacacttagggagtcaggagaatcacttgagctcaggagttctagaccaatctgggcaacagagagaccccatctcttttaaataaaaagttaaattgcttaatttcccccgt

SEQ ID NO: 13798 - DNA, 1426 bp, Homo sapiens
gcatttccgcccacgtgggaagctatgcggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgactttcaccaggccttccctcgtgccaaattcttggcctcaaggccaaaatcccttataatgaggtcgtttaaaatccgtaatcatgtaataaactggtcctgggtaaaattgtaacccccttaaaa

SEQ ID NO: 13799 - DNA, 579 bp, Homo sapiens
gaatcactcagatggattctttttcaggctttgatactcatcttacaggtctagattgttttcttccctgtcaaggtcatcaagaaggcaaattagccagagttgattctgatagacccgtcagccctaaacacctccagtcgttttgctagagaagctctgacgtctccaccttgtctccatgtgctggtgcttaaccaagggtcctgtttgcagttaaaaccagaccatggatttaaaaaaagaaaaagaagatatcaatagaaaatattctgttttcaaaacaactaaacaaaaaatctgacaatatataaaaaccctatttcagtggaattgaccttgtgatatttagtggtgccttgggcttgttgacattgagcagcttgttcacaaagaggcccagcaggttatttttccacttgttaaattttcagaatgtttcttattacatgcagtccagttcttgggtccacaggtcagttttggctgttataatctgcccttgctaaattttcaagggtaggagaattctctggttcttattctccttctccttcttccctttctttttccagtggt

SEQ ID NO: 13800 - DNA, 417 bp, Homo sapiens
tgtctttttaacatgctgtaactatcataacttcatatatcaggtgtgttgaatttaaaaaattttattgtaaactaaaagtaaccaaatctatgaggatatttcatttttaagaaacattgatttggctgggcccggtggctcatgctagtgtaatcccagcactttgggaggctgaggcaggtggatcacaaggtcaggagatcgagaccatcttggctaacacggtgaaaccccatctctactaaaaatacaaaaaattagccgggcgtggtggcaggcgcctgtagtcccagctactcaggaggctgaggcaggagaatggcgtgaacccgggaggcggagcttgcagtgagccgagatcgtgttactgcactccagcctgggtgacagagtgagactcagtctcaaaaaaaa

SEQ ID NO: 13801 - DNA, 492 bp, Homo sapiens
ctgaatagaaaataaaagctggtgggacccacggtctcctagggagacagtaggagccgggtgctgctccaaagtctgggggcccattctatgctctgtgggtctcctgaagggactcagtgaattctcggaggagacaccttgcaacacgttcctgtgcaaatcctgcaggaaatctaggggtttctccctggacttggttggctttaaccccttctcctggcctcgtgtatgccccacttcaggagggaggacagcttcagtaaatgcactaggatccagagaggctggagtgcagtgacatgattttgactcactgcaacctctgcctctcaggttcaagcgattcttgtgcctcagattcccaagtagctaggattacaggtcctgaaaaggttgcatcagccctttagccattacctgcctcttgatgaagcgtcagagcaggtgtgcatacacctgccagcacagaaaaaccttaacgtaaagttg

SEQ ID NO: 13802 - DNA, 394 bp, Homo sapiens
ctgaatagaaaataaaagctggtgggacccacggtctcctagggagacagtaggagccgggtgctgctccaaagtctgggggcccattctatgctctgtgggtctcctgaagggactcagtgaattctcggaggagacaccttgcaacacgttcctgtgcaaatcctgcaggaaatctaggggtttctccctggacttggttggctttaaccccttctcctggcctcgtgtatgccccacttcaggagggaggacagcttcagtaaatgcactaggatccagagaggtcctgaaaaggttgcatcagccctttagccattacctgcctcttgatgaagcgtcagagcaggtgtgcatacacctgccagcacagaaaaaccttaacgtaaagttg

SEQ ID NO: 13803 - DNA, 437 bp, Homo sapiens
agttttgcatagtagtagatcagaaatggaaaataaataggaacatcaaggtaattcttaccagctgaaaattccttgagagaagccgaagtatggcatctttaggatctactactgtctcaaataacagaaggggccactccacataccttttgtttcattagacgatggtgataatgaagataaaagatttgaagcatcaaatggcatagagatcctgggacattaaacacagtattcctctctgtagcattaataaattgtgatgaggtttgaaatactatatttgcctccttagttcttgtttcaaacagctgaaacatgtaacttggaaggtttcacctaagaaaatttgttgaaatcaattctgtaggaacaagaaaaataacaatactcatcacacattgtttctgcattaaagtattttcggtgaatgt

SEQ ID NO: 13804 - DNA, 690 bp, Homo sapiens
gagctcttcccctgcctcaggcactttggactgaggttctatgcctacaaccctctggctgggggcctgctgaccggcaagtacaagtatgaggacaaggacgggaaacagcccgtgggccgcttctttgggaatacctgggcagagatgtacaggaatcgctactggaaggagcaccactttgagggcattgccctggtggagaaggccctgcaggccgcgtatggcgccagcgcccccagcatgacctcggccaccctccggtggatgtaccaccactcacagctgcagggtgcccacggggacgcggtcatcctgggcatgtccagcctggagcagctggagcagaacttggcagcggcagaggaagggcccctggagccggctgtcgtggacgcctttaatcaagcctggcatttggttgctcacgaatgtcccaactacttccgctaggcccatcgtttctcaggctgcccaaggctcttctgtaacatcttttgttactcacattttctttaatttagaactgcctcagtaaattcttagggatggaagtatttggacaaaaacctaatagaagagtcaccaccaaatgaagaataaaactcccagggtgctgtgtgttagtctgtttgcgttgctataaaagaatacctgagactgggtcatttataaagaaaagaggtttat

SEQ ID NO: 13805 - DNA, 363 bp, Homo sapiens
aagtgacttgctttaagatcataaaactataaacatcagtcagaatctaaatggaggtttgattcccagtctggtgttctatcacaactatatctaaaaaccccaacgatgctctaaaagggaactattttgaatcctgtaacttaaagaatgttctgtgtattggattaaagtgtttcctagctattccaagtgtccccatctatttcaatcttaacataatgctcacatgtcacacaatgacatggatttaatgtcaatttataatactaagtatattatgtttctaaagttactatattatttgaaatagtaagggtatctgaaagattcaatttgtgatgtcaaatttacaaactgtcc

SEQ ID NO: 13806 - DNA, 398 bp, Homo sapiens
ttgcttcttagattggatgatgggtttgtaagtgttccttctgttgtgtctcatgatacagacccatgccctcaagcatgcattgtaattgaaatgccattaaaatgtattttacacccaggcgcagtggctcatgcctataatcccagcactttgggaagctcagacaggtggatcacgtgaggccaggagtttgagaccaacctggccaacatggcaaaactgcagctgtactaaaaatacaaagattagctgggtgtattggtgggcacctgtaatcccagctactcaggaggcctaggcgagagaagcccttgaacctgagaggcggaggttatagtgaaccgagatcacaccactgtatttcagcctgggcaacagagcaaaactctgtctca

SEQ ID NO: 13807 - DNA, 443 bp, Homo sapiens
attagatattaaaaaaagtcagtgggggtttcctcatagaaacaagggaagacctttactgagattgcttctcagtttattggtcttcatttgttttttggctcatgggacttgaacataggtagggtacaactttatttacataggagccaagagaaaacttcctcttgctatctctaggtttgctaaaaatcagctgacaaaaagcagattaatagaaaaggcatacaaatctgccgggcacggtggctcgcacctgtaatcccagcactttaggaggccaaggcgggaggatcacgaggtcaggagttcgagaccaggctggccaagatggtgaaaccctgtctctactaaaaatacaaaaaattaaccaggcatggtggcgggtgcctgtaatcccagctattcaggaggctgaggcagagaattgcttgaacccgaga

SEQ ID NO: 13808 - DNA, 309 bp, Homo sapiens
caaaaaagactcctgttattgccttagatgtatatactactacctcattggacatctgcattttcagaattctaagtttagtcataagcggtcacattaatctaaaaaataaaaataaaaggaagccatctctactcaccattttgtataatataatgaaatagttacaatgtatgttttatagccagaaagacgtaggtttgaaatctagctctatggctactagctagtgactttgggcaggttatttaacccctttgaatcatgcacacttggataagtagccggcagtaaatgtgaaaattgtca

SEQ ID NO: 13809 - DNA, 221 bp, Homo sapiens
tatgttctagcaattgtatgttccaaatgtgctgctttcagttttttcgagaaacaaatgatgtttgactttaaaattctagagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaatta

SEQ ID NO: 13810 - DNA, 306 bp, Homo sapiens
atgtttcatgacagaattccccgtttctccccactgcccactttattttaatggaatttcttttgaattgcacctgtattgtcagcacaggcctccctaaacggtacagccatccagggagggcgatggttccagtaaaggagcagacacattcctgaccctgatggaggagacgggagaccacctgctctccacaccccctgtccccagccactttgctttctcctgcagccaggcctgggctgctgcggttcttttctatcaaacctctttatacccccaacctggaacttgaaagcagaggaa

SEQ ID NO: 13811 - DNA, 923 bp, Homo sapiens
  misc_feature (841)..(841): n is a, c, g, or t
agcggggtgtgcggcggcagcggcgggcgcgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttggcaccctaaaaagaaagaataaaacaacaacaggaaaaaaaggaaaatatttaaattgtgacaaaaacccactggataagccagctgcagaatatatcctgaggtacctgctttatggaattattcacactattcaccaacaggaagaataaagtcaatcaattcaaggagtctcagaacaggagcacatagacaccaaactttgtgggacaacaaatataatgaagagtatgtttgcgtctttcaaacaaagccacgtgaagtcaaggcccttaacacccacccctcccacatactgaggggagaattcagatgcccactggagtcagccgatcagactgccttttgcacactccttgcctccactccagtttaccgtggaagacctgtctgctatggctgaatctgagagagatccttgagtaacgaattaaggaatgaacaaatgttgctctggacaaagctgcagcttccacgtcctgcataactgcactcagtactgaccctgaagataggaaaagcaatacaactggtgctagaaatgtcctgcgaatgacttgggattgagtggaacactggcactgatctcctttgaacaagctccttggaaaccacagggttgtcatggtagctgttatcaaggnagaacgggagtgagaagatgctgacgaaacaccctgtttctccttccctgaacgaggtgtaaggccagatgcccccttcgtc

SEQ ID NO: 13812 - DNA, 593 bp, Homo sapiens
agcggggtgtgcggcggcagcggcgggcgcgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttggcaccctaaaaagaaagaataaaacaacaacaggaaaaaaaggaaaatatttaaattgtgacaaaaacccactggataagccagctgcagaatatatcctgaggtacctgctttatggaattattcacactattcaccaacaggaagaataaagtcaatcaattcaaggagtctcagaacaggagcacatagacaccaaactttgtgggacaacaaatataatgaagagtatgtttgcgtctttcaaacaaagaaatgttatgagaatgacttggatgagctgaaaaatgaatgatctccttgaacaagacgcatctgaaatttggtgccatgactcgaatcgggggacctcccttggaagatcaatcccctgtcctcctgctctttactccatga

SEQ ID NO: 13813 - DNA, 1123 bp, Homo sapiens
agcggggtgtgcggcggcagcggcgggcgcgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttggcaccctaaaaagaaagaataaaacaacaacaggaaaaaaaggaaaatatttaaattgtgacaaaaacccactgggttctcttggttacaaactccttcccttctggtgctgcaaaaatgagtgggaaatccctgctcttaaaggtcattctcttgggtgatggtggagttgggaaaagttcgcttatgaaccgttacgtaaccaacaaatttgactcccaggcttttcacaccataggggtagagttcttaaatcgagatctggaggtagatggacgctttgtaaccctccagatctgggacactgcagggcaggaacgtttcaagagccttaggacacccttctacaggggagcagactgctgcctcttgaccttcagcgtggatgatcggcagagcttcgagaatcttggtaactggcagaaagaatttatttactatgcggatgtgaaggaccctgagcatttcccctttgtagttctgggtaacaaggtagacaaagaggataggcaagtgactactgaggaggcacaaacctggtgcatggagaatggggattacccttatttagaaactagtgccaaagatgatactaatgtgacagtggcctttgaagaagctgtcaggcaggtgctggctgtagaggaacagctggagcattgcatgttgggtcacaccattgacttgaacagtggctccaaagcagggtcttcgtgctgttaaagatagggagccttttaaaaatgtgccccaaattgatcagtcagtagtgtaagaataactgtgcccctctaagagtgcacacacacgcacacaagagggtaagagacaaggttctgattgtgaaacagagcctttcaaattgaagtgtagattgatttaaaaaaattaaaaattaaaaaaaatgaagctctatcaagccaagt

SEQ ID NO: 13814 - DNA, 300 bp, Homo sapiens
ggcggccgcctactactactaaataaacggccgctcgactacttgcatgtgtaaaaataactaaaagaatataattggattgtttataacacaaagaaaggataaatgcttgaggagatggatactccatttactctgatgtgattattacacattgcgtgcctgtatcaaaatatctcacatagcccataaatatatacacttattatgtacccacaaaaattacaaagtaaaaaagcatttaaagtaccttcaagcttcctgtaagcgtcaccaccatattcattgaaatggtcgacg

SEQ ID NO: 13815 - DNA, 3537 bp, Homo sapiens
ctcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttgc

SEQ ID NO: 13816 - DNA, 2839 bp, Homo sapiens
ctcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtttgaggctgcagtgagtcatgatcgtgccactgcactccatcctgggtggtaaagcaagaacctatctcttaga

SEQ ID NO: 13817 - DNA, 3654 bp, Homo sapiens
ctcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataatctagatccatattaacctggattggtctcaaaaacataatgctcagtgaaaatagcaagttgtagaaagttatatacaaattatatatatgtacaaaacaatactatgcattctctatggctatataatgtacgtaaatctatttttaaaggttcagaggaatccataccaaagttctaacagcgagtaggaggtatagatgagagattaggggtgcaaatcaggattgggagggtggtcagagggaactttagctttatccataacattaatttttttaaaaaataaggtcttaatgtttcatttaatttaaaatatactgtcatgttgtgttttgtaaatcaactgaattgaggtactatttacttagatttattgcaccctttttacgtgtgtattttattgggttttgacagattcatacctctgtgcagccactatcacgatcaagatacaaatattttcattgcccccaaaattctcataccccctttcccaatcaattcctctacccctagccctaggcagccacagatttgcttttggttaccgattagatctatccattgtagaattcatgtaaatagaatactgtagtatgtactttgccttcttcctctctgcagatttttgagattgatccctgtgtgtcagttgtgcattttttttgttgctgagtagtatgttctatcttatgtcagatcattcacgtgagactttggcatgaaatgttaagcatccgacatctaaatagcaatattttgaatactggaaactcaggttaaagattttgtttccaagtagaaatgaaatcttattattttaataagtagctgacagtgacagaaagattggatttggatcagattggctgttaggcttcaggtatgggaaacagctctcagatttataaattggaaatcaccaggttacttgccaatatatagtcatattgctgccattgtacttaatttctaaatatataaaatccacatttaaaaattataaaagcaaggacttgggagtgactgatgaatcatgaaattgctgcttttatagatcaaaactacttgaatcatcaggaatttcatatttttcatattgtgtgacaacttataattttgtttcaaattgtgatttcattgattttactaactggaaggaagaagagtaaaattggcatatttaggttttttgtagaagaaagatacaagtgaaaattaggagtggattggagaaattggggggaaatagaagagtacggagaaaggaagagattgaaaatgttaccagagttctttaaagctcacattttatagtatcactgctacaaactatttaatgaaatgtggcatcgggtgaaaagaggcatttgtttgatccttgaacgaattaatctcacgtacttccctgtttgtggtttgagcctttcactggatgtgagctacttgagagcagggtttatgccttcatcagcgtgacccctgtgcctgcagcctcataggtgttaatctgtaattttaaattttgacaaaagcattttcacagccctgccacataagatctagtttttatttctagagtgctgctatgaataattactatagctgctgtccatcttgcccatccattaaggtaccttctcacaaacatttctaatctactggctggagtgcagtggtgcagtctgtagctcactgcagcctcaaactcctaggctcaggcgatcctcttgccctggcctcccatgtagctgcaactataggtgtgtgccactacacctggctaatgtttttagttttttagagatggagtcttgctctgttgcctaggctggtcttgaactcctgggctcagatgatcctcctgtcctcagcctcccaaaatgctgggagccaccaggcaccaggtgtgatctaccacacctgtctaaaaagtatgtatttttaaatttttttgtagagacaggatctcactatgttctccagctggtctcaagctcctggcctcggcctcctaaagtgctgggattacaagtgtgagccactgtgcctagtcactttaattgagatattggcaagtcaactgccatgcagagcccagggcactggttatattcagtaggaaactgaactcagcactcagaattttaaattaaatcaatgatcttcaagtatttgccactttcgagtacagctaattggataatctcaaaccctttagtgaaaatatcttaaatgcattgagaatattttctaattacctgtgtatgctacagtacagacattaattctataaacatgttcataggtcttccccctcgccccgcccgtcttctaagggcattttctgtttctttttagtgagttcatgaatgtttaacggttctggcgcaaagctttcttgcattctgagcataaaaataataaaacccacttatatttgcttgagtgtgtttacaagtcaatttccttttatgtagcttgctttttcatttgctataattgatcctgcaggtgtgtgaattattaaactaacgctcttttaaaccacaaaaaaaaaa

SEQ ID NO: 13818 - DNA, 851 bp, Homo sapiens
ctcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagccaggtgtggtggttcgcgcctgaaatccagctgcttgggaggctgaggcaggaatcgcttgaatccgggaggcgaaggttgcagtgagccaagatcgtgccatttgcgctccagcctgggcaacaagagtgaaactccatctcaaaaaaacagaaacaaacaaataaaaaaactaagagacgaaactgaaataggaataatcaaagtgatttttttttaattacgctttgaaattctgctttaaaattaactttgagtatatgtaaatgataaccagaaaattcttttcaaatagaatgttaaagtagcatattactgttgaaagtggtgtattactgttgaattatt

SEQ ID NO: 13819 - DNA, 4796 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagaggtgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtttcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccatgtgattatttgcctcgcttgttctgaaatctctacacatttcatccttttgcttgcttacgtggactggggcatggcctaagacaagatctttatagccccctttctgataatcagagagaacgttttgtctagtccgaccaagagcgaaggaatgtttgtttgtactgtgccaaactgttcctcagatccaattgttagcacaaaatgactatatactccttttaagaagcaggaaagcaggtttcctgagtgatatgttgaggcacaattattttttcctttttggttacttggtgtctttatttaagaggcatgaaattttgagagatttgggggctttgctaacctcccttatgctctgtatacaacacttctccatcccccaactggtgtcttaccccaaatcagaccatctgagcccactactatcaaacaaacaaacaaaaactgttaatatattagccataatgtttttaaatgataaaggatgaaataaattcccagtgctcatcatgagggaaacatgtgactatacctttcctatgaggaaagccaggttatacatagagttcctttgtcatatctttagacttgatttgagtagacagcaatgatctttacatagcttagtgttctgatggcaaaatattgtatatgataataattatgtcctatttatttgagatttgtgtttaaaattaaa

SEQ ID NO: 13820 - DNA, 7486 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagaggtgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtttcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13821 - DNA, 6852 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagaggtgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtttcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtaaactgattgggatcctctagatcacccg

SEQ ID NO: 13822 - DNA, 6845 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagaggtgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtttcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacttccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggtgggtcaaactatgaaaacattccttccttccctggcatgactccatgaatttgtctccagaacggcagcaggaaagtcttttttgtttcccctattcaccagtgtcttaccagcctctcgcaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13823 - DNA, 4697 bp, Homo sapiens
ctggaacgagtttttgagatgagatgaaaactaactatctcgcttccctggcccaaatagaaatatgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13824 - DNA, 4333 bp, Homo sapiens
gacatacatgacccacatcagagaagatcttaaaatggtttattaaactcctaattgtctagaaattcaagtcagactgcttgaaatggggacagagaagtcacacttgttattcagatacagggcttctgcacacctcctggctggaggatgtcttctctggggtcttcatttctttatgctctgtccctctttgcagagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13825 - DNA, 2601 bp, Homo sapiens
ggacgcgtgggtcgacccacgcgtcgcgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13826 - DNA, 5559 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagaggtgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtttcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13827 - DNA, 608 bp, Homo sapiens
gtaaggatccgctgaaaacttttgtctctccgttttcattcatcttgtttgatgttctcattggtctgggggcctggggagaagttcagaaaagagagggaagaaaaaaggggcatgaagggaagtgctttggagctcttgttgaccaaacgcaaaccaaagacaagatggaataaaaagggttttgcatgcccttgtcaagtctggaaatgtgttagtttgtctgtagtaatggagacaccaggcagtttctttgcaaatctggtgggtccattctttctaattatcaaaggaagtcttttgactgctttattgaattgtcactggcattacccaaaggagactaactgcagaaactgttcatatgcaggggcttacaaatgaaaattggacaaggttttcttagctctatttgatttagcctcactcaaaaaaagtgatattaatattgggaaaatggttctaccttactgccgcctaaaaacttaattctaataaaatctgcctgaagtaaggaagaaaaccattttgggggaagtagtttagaaacttcaatgcctctaagaagaggtggcctcagaggacacagaagagagaaattttataat

SEQ ID NO: 13828 - DNA, 458 bp, Homo sapiens
aataaaagtaatattaatattttaattagcagagttttatggaaagagagtttttaggtagctaccaaagaagaatagggtatataatgaagggagaaaagtaatttatatctgcaaaggggaaaaagagagtgagtcatcaataggccacagataaacatctggaaactaagcaagaaatactctttccaccatttaagaattgttgcagtgcttagcacaatgtcttgtacacagtgggtgctcaataaatgtttgcggcatgcctgcagacatgaatgaatgaattgttcccagagatgtgaaggctattgatgtaacagtaaacataggagagcaatgtttcatccatcgttcaattactcaacagatttatattggtcacatcgtaccactgggtgctgctgatactgacggccgcctgaggtctggagatgaattaatctgtgtggatggga

SEQ ID NO: 13829 - DNA, 369 bp, Homo sapiens
tcatgactgatttttgtcagttctttaatgatctatgtctcgggtatggagaacattcagtcagccagacgctgaaagccacaagtactagtttttaaccctaactacgtgcagttatccttaagttaacagattcagttggctttgagtctgactgctttaacagttgtttgcttgttgtgactaatgaggtctcgagtgtgggtgggaacggggacaggagccgagggaccttcgtacccaactgttgctctcgtttattttcctggcagaccccagcagcgaccgccacggccccgccaccggtccacaaggtgttccggaagtgagggccgggcccgaccgccggcagcatccgtcattggagtc

SEQ ID NO: 13830 - DNA, 281 bp, Homo sapiens
cagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttggtgagtgctgaacgtgaaattacccagggtttc

SEQ ID NO: 13831 - DNA, 7659 bp, Homo sapiens
cggaatgcaaacaaagctcgcgggcgcctgtgcggggctcgcggggaagcccagaaagtttgttttatgatggcttgagtgcgcgagcgtgtgcaggggagcgaggctgccaagtttctctctcctgttttgtgatttggggagaggtgtttctcccatgaacaagcggaggcttgggggctcgtgctgtggggggcacctgtctctcgttttatttttttggaggaggggtgtaactcatcatgtccaaagtgatccagaagaagaaccactggactagcagggttcacgaatgcaccgtgaagcggggaccccagggcgagctgggggtgacggtgctgggaggcgcggagcacggggagtttccgtacgtcggagcggtggcggcggtcgaggcagcggggcttcccggcggcggcgagggcccgaggctgggcgaaggggagctgcttctggaggtgcagggggtccgggtgtccggcttgccccgctatgacgtgctgggggtcatcgacagctgcaaggaggccgtcaccttcaaggccgtcagacaaggaggaaggctgaacaaggacctgcgacattttctcaatcagcgattccagaaggggtttcctgatcatgagctccagcagaccataagggataacctttaccgccatgctgtgccttgcacaacccgatctcccagagaaggagaagtgcctggcgtggactataactttctgactgtgaaggagttcttggacctcgagcagagtgggactcttctggaagtcggcacctatgaaggaaactattatgggacacccaagcctcctagccagccagtcagtgggaaagtgatcacgacggatgccttgcacagccttcagtctggctctaagcagtcgaccccgaagcgaaccaagtcctacaatgatatgcaaaatgctggcatagtccacgcggagaatgaggaggaggatgacgttcctgaaatgaacagcagctttacagccgattctggtgaacaagaggagcacactctccaagaaacagcattaccacctgtgaatagtagcatcatcgctgctcccatcacggacccttctcagaagttccctcaatacctacctctttctgcagaggataatttaggtcctctacctgaaaactgggagatggcctatactgaaaatggagaagtctattttatagaccataacacgaaaacaacatcttggttagaccctcggtgcctaaacaagcagcagaagccactggaagagtgtgaagatgatgaaggggtacacaccgaggagctggacagtgaactagaactgcctgctggttgggaaaagattgaagaccctgtctatggtatctactatgtagaccacatcaacaggaagacacaatatgagaacccggttctagaagccaaacggaagaagcagcttgagcagcagcagcagcagcaacagcagcagcaacagcagcagcagcagcagcagcagcagcagacagaagaatggacagaagatcactcagcccttgtgcctcctgttattccaaaccaccctccaagcaatccagagccagccagagaagttccacttcagggcaaacccttttttacacgaaacccttctgagttgaaaggcaagttcattcacacaaagctgcggaaaagcagtcgtggctttggcttcacggtggttggaggggatgaacctgatgagtttctccagatcaagagcttggtcctagatggtcctgctgcattggatggcaagatggaaacaggggatgtgattgtaagtgtgaatgacacctgtgttttgggacacacacatgctcaagttgtgaagatcttccagtccatccccattggtgccagcgtggaccttgaactctgccgaggttatccattgccttttgatccagatgaccccaatacaagtttagtgacctcggtagccattttggataaagaaccaattattgtgaatgggcaagagacctatgattcaccagctagccacagtagtaaaacaggcaaagtcaatggcatgaaggatgccaggccaagcagcccagcggacgtggcttcaaatagttctcatggttatcctaatgacactgtttctttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagttcccaagaagagcccaaagtcgcaaccactggaaaggaaagacagccagaatagttctcagcacagtgtttccagccaccgaagcctgcacacagcatccccaagccacagcacacaggtgctccccgagttcccacctgcagaggcccaagctccagatcaaactgacagctctggccagaaaaaaccagatccttttaaaatctgggcccagtccaggagcatgtatgaaaaccgacctatgtcaccttcacctgcgtcgggattgagcaagggtgagagagagagagaaatcaattccacgaattttggagaatgtccgattccagattaccaggaacaggacatcttcctctggagaaaagagactggatttggatttaggattctgggtggaaatgaaccaggggaacctatttatattggtcacatcgtaccactgggtgctgctgatactgacggccgcctgaggtctggagatgaattaatctgtgtggatgggacgccagtaattggaaaatcacaccagcttgtggtccagcttatgcaacaagctgccaagcaaggccacgtcaatctcacggtgcggcgtaaagtggtttttgcggtgcccaaaaccgagaacgaggtgccctcgccagcctcctctcatcacagtagcaaccagccggcctcgctgacagaagagaagcgcactccgcagggcagccagaactcgctgaacacggtgagctcgggcagcggcagcaccagcggcatcggcagtggcggcggcgggggcagcggcgtggtcagcaccgtggtgcagccctacgacgtggagatccggcgcggggagaacgagggcttcggcttcgtcatcgtgtcctcggtgagcaggcccgaagcaggcacgacctttgcaggcaatgcatgtgtggctatgcctcacaaaataggtcggattattgaggggagccctgctgaccgctgtggcaagctgaaagtaggagaccggatcttggcagtaaatggatgttccatcaccaacaaatcccattcagacattgtgaacctaatcaaggaagcgggaaacacagttaccctccgcatcattcctggggatgagtcctcgaatgccaccttgctgaccaatgcagagaagattgccaccatcaccaccacacacaccccttctcagcaagggacccaggagacaaggaataccaccaaaccaaagcaggaatctcaatttgagttcaaagcaccccaagcaacacaggagcaagatttttacactgtggaactggaaagaggagccaagggatttggctttagccttcgaggaggccgagagtataacatggacctctatgttctgcgcttagcagaggacggtcctgcggagaggtgtggaaagatgaggattggtgatgaaattttagagatcaatggtgagaccaccaaaaacatgaagcattctcgagctatagaactgattaagaatggtggccgcagagttcgtctgtttctgaagcggggagacggctcagtaccagaatatgcgatgatacctcctaatatcgctgcatgtatgagaaatgaaaagctcggggaggcttgcttctaccttatgggccataatcaaactacgaccccagcagcgaccgccacggccccgccaccggtccacaaggtgttccggaagtgagggccgggcccgaccgccggcagcatccgtcattggagtccagttacccacccgatcttcacaaatcatcaccacatggggaaaagcgggcacacgcaagggatccgaaaggcagcagagagtatagcagacaacccaatgaacaccacacctggaatgggacttcgaggaaacccgacagcggggcatgccgacccaaggaccgggcgccggagggacggagggacgcgcaggccgagcgcgcggcagccgccaacggccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgcatacttttttggaaattatttgccaaatgctggcccaaagggatataaattttgtttctacgtaacctgtagaatcgtcaagaattgttcccgttttggggcaatctttttctctcctggttaaatggggctgttgatcattttctctacgtaagggaatttattgattaagtttaattaatttgatatagactgtcatgtagtgatgtagtgctatactgtagtcggaagtttttcttaaaagcaaagagcaaaaatgcaaagttttatttgtaaaagctgaggacccttggggatggattaggtttgccgatgatcctaaaagtaagcaaactgtatgacaagactactattgcaaatgaaggatatttatagctaaactgcgcagcacaaagaagttttatattgtgagttatagttggttcagaaaacagtttgtactctccctggcccaggaaggcacacagacaaaaatgtcggccacttttactcaaatacagcccaagcacagacagtcaggttcgtgatcatcaccaacatctgataaaatctcattgaaggcaatgccatcacagctttgctcaattactacgaggaagagacaacaagcatctttcgtgttgtctcgtctgattggaggctgaatagtagatggaatggggggacagtgtgcctggtgtgaggaagacgtaagatccccaatttggaaagcatgcccccctcccttttagtagaagcccatggttgccctttgccaaactggggaggaggcaatgagccttggtggaaggaacctctctgttgatatttaaagaagtgagggctgtgggtattcattgttagaaatgccaatttcactttgaaaccatagtccaagtctctaggttggtagaagggaaaggaaggaagtggtcccagtgattctagatctggttgggaaacttctgcctcatgactctgtcctttgagtcctttggacagcagcacaaaacataacaatttttatttttaaacagacccattctttttgatcccacaggagctgtggttgggtcggccgtagccccgggatgtggtttaagtggattactgcctagctgagccaaaatgtttgcttgtacctgttggaccactacagcaaaccgctgcttacagtgcattgtgtatttctgtagtactgttttgcattttccatagagacagaaaactttgcaagtcaatcactgttgttcccatggtactgtaagaaaaaaaaaaaggaaaaagaaaaaaaaaaagaaaaccagccaatcattgcgtgtacagagctaaaaattgtaattaatagagcctgttgggaaaaaaaagaaaacaactgttgcctttttttcttgtataaaagagaatttatgacaaaatttagctgtgaggaatgtgatacgtgtttatatttctgaatatggaacaaattgattcatggggatatattttaatgtaaactaaatcaggtatgtaaagttgttttaaaatgggagactatataagtaattctctaaagctttagttggtttgaatatcatcatttcctccatggtgagcctgcttgtgaattattaagcacttgtttgcattctctgttcttcactcatttatttcttgcagtgtgctatggacttaatgctctttctgtattgatgaaaagcagtatgtgggccaatctttttataaaacactatgcatatataaatattacattgttcatagctttatttgacttatgggtttatacataacattagaatgagtagctgtagttgtgtggacatttataaaacaagttcctttcctggaacagacacaatatacattctgtagctaaaaaggagggaaaagtctgtgaatgctatttttattattaaagttttccatacaaagcatacattgagctgtagtaaggctgaggaagagtacaactgaataatgatgttctttttcatcaagttcctaagagctgacttggagattttattcccagggctccactgctaggattcttctcactagttctaacaaaatctgtgatgttaaatgactgatgctctcaattgtgatccagagttttaaataaatgaaatcaaggtggattttgggaatatatcctgaagttaacatcttgatgtccttcttgttgtaagatgatatttggcaatttaaaatctatgtgctacccacctgggcttgtctcaatccgtggactttttggtgtggcagtttcacctgaattccacacatcagatttgtttggaaatattgtactgtacagggactatgcattatgcagaaagatatagttttctttgaactgctgtaaccttaaattggaaactgattcttgtgagcctactttccttaatcccgccgcccccctcccccacttaatgtaaatgtcttgatgagagataatggatgagtattttgtatgatgaaatcaaacgatttaggaatttgtctccctccgttacacagttgatgcctgaaagaatgttgggggggaggactcaacaccctaattgtattttttaagtttcttttgtgaaagattttttaatgcatttttactgtaaaaatacatggaaatgtatgcattccacaacca

SEQ ID NO: 13832 - DNA, 2436 bp, Homo sapiens
ggcacgagggcacggtgcccgctctaccccgccgcagcggctgggacgtacggagcccgcaagtcccggcccgaggtccgaggaggcgtcctccgcccggtggcccagagggaagcggggcacggcgtcatcatgcacagttgtatcgcgcccgccgcgcgtccccggagccgcccctgagcccgaccgcgagttcgagctcagggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgctggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttcttggggcatctgaaagtatggcagatgtgggcgggggttgtgggggacggcatcggcctgcacctgacgctgaaccagagctcaggaatgtcaagtaacttaataaatgagtgaatgtgaag

SEQ ID NO: 13833 - DNA, 2314 bp, Homo sapiens
ggcacgagggcacggtgcccgctctaccccgccgcagcggctgggacgtacggagcccgcaagtcccggcccgaggtccgaggaggcgtcctccgcccggtggcccagagggaagcggggcacggcgtcatcatgcacagttgtatcgcgcccgccgcgcgtccccggagccgcccctgagcccgaccgcgagttcgagctcagggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgctggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttc

SEQ ID NO: 13834 - DNA, 2311 bp, Homo sapiens
gtcctgcctcgagtgatatgtatgcgagtgcggaaatccgcagggtccgagagatctggaggatgcgtaccttccgtgctctgtgtggaccacaaggtaacggcggtagcacaggtgttagtactcttgcccggtcttacttatactcagtcgtcttactcgcgatcggcccatgttaacgagcgttaatgcaatccgtcaggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgctggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttc

SEQ ID NO: 13835 - DNA, 2400 bp, Homo sapiens
ggctgtaccgagcccgagtcttatggatccacctcttaacaagcgcaaggttgctttcgtcaacccttctgttgtacagaaagagaaactgaggcccgatgggcacagacttgttggcccacttccactcggtggcagagctggcccagggaaaaatgcaggtccgaggaggcgtcctccgcccggtggcccagagggaagcggggcacggcgtcatcatgcacagttgtatcgcgcccgccgcgcgtccccggagccgcccctgagcccgaccgcgagttcgagctcagggcccgcccggccgcaccatgagccacgggcccagcccccggctggccgagtccccgcagctgtccaagggcagcctcctgaccatcctgggcagcccgtcgccggagcgcatggggcctgccgactccttgccgcccacgccgcccagcggcacgccctcgcccgggccgccgcccgcactgcccctgccccccgcgcccgcgctgctggccgacggcgactgggagagccgcgaggagctgcggctgcgggagctggaggaggcgcgggcgcgggcggcgcagatggagaagaccatgcgctggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggaactggagctggtggagagcctgctgaagagcatgccagaggagtctgaggactgctgggaggcgcgcagcctgggggctgggggcccgcggggcagctcaggccgccaggagcgcagccggctaccctgggaggacacagctgccacggaggaggaggcctccaagttgaccgccctgcggctacggctggatgagtcccagaaggtgctgctcaaggagcgagaggataaactggcgttgagcaggaacattgagaagctagagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttc

SEQ ID NO: 13836 - DNA, 1270 bp, Homo sapiens
ggcaccgtgcagctgcgaccgccgccggagggggagctcagccagtggaagatcaagtatgaggagctgagcaagaccaagcaggagatgctcaagcagctcagcatcctgaaggaggcgcaccaggacgagctgggccgcatgtctgaggacctggaagatgagctcggtgcacgctccagcatggaccggaaaatggccgagctgaggggcgagatggagcggctgcaggccgaaaacgctgcggagtggggccgccgggagcggctggagacagagaaactgggccttgagcgggagaacaagaagctgcgggcacaggtcggagacctggaggaggcgctggcccggcggcggcggcaaacagccagcgcactggactgcgacctgagggccagccaggccgcgctcttcgagaagaacaaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttc

SEQ ID NO: 13837 - DNA, 964 bp, Homo sapiens
tctgggaaggagagacacccagcatccctagaactgcctgacctcgtgggactccctggcatggcgcccaagctgatactgattccctcctccctcccaccccatccctgtgccctgtaggagctggcagacctgaagcatgtgcatggcaagctgaagaagcagttccaggagaaggtggcagagctggcacatgccaaccggcgggtggagcagcacgaggctgaggtgaagaagctgcggctgcgggtggaggagctcaagaaggagctggcccaggctgaggacgagctggacgaggcccacaaccaggcacgtaagctgcagcggtcgctggacgagcagacggagcagagcgagaacctgcaagtgcaactggagcacctgcagtccaggctccgcaggcagcagcagaacgctcccctcttcgggaagatccgcagtgctcgctttggcaccgaggaggccgaggatggaaccagtgacctggacgaggacgaggacctgcaaatccaggtggcctagagcttcctgtggctgggcaggatgggccgccccatacctgcccagggtccaggctaaccagccactcaaactgatgcagtgcctaggctcactctgggaccagtccctgccacagccgactttcttctctcccagggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttc

SEQ ID NO: 13838 - DNA, 399 bp, Homo sapiens
ctgggagagaagaaagtcggctgtggcagggactggtccagagtgagcctaggcactgcatcagtttgagtggctggttagctggaccctgggcaggatggcgtcaacagtcccacctaccaacgccctgtggaaaggaagcctatgttttatatatatatatacacacacgcgcgcgcgcgcgcgcacacccagaagtctttggacccatttggttttataaatacaggacagctccaaggcccagtccagatgacctcacccacccaggacttcatgcagggctgggcatgttgggggcagttgttggagccccaccctgggctgcctctctaggcttcgctgttcatcatacaatgcagtgaacccagttatttgtaataaatgaagttcaagttc

SEQ ID NO: 13839 - DNA, 503 bp, Homo sapiens
ctgcggctgcgggagctggaggaggcgcgggcgcgggcggcgcagatggagaagaccatgcgctggtggtcggactgcactgccaattggcgcgagaaatggagcaaggtgcgcgctgagcgcaaccgcgcgcgcgaggaggtgcgccagctgcgccagcgcctggacgcgctcaccaaggagctggcgggcgcacggcgcgagcgccaagaggcgcagggcgagtgcgaggcacggggccgcgagctggcgcggctgaggggcgcccggggggtcgccgaccagacgcgcgacggccccgagccggaagcggagcgcgagccagtgcgtgacgtcgggtccgagaggccgccaggcagccaggtgcgcggcgcgggcggggcgttcgcgctccagtctcgaagtgggcggggccgattgtcctgagctgctgggctcagaaacaagctagtaaaggcctggcctcctggaggtttcacttctccaggtcgggttctaccctt

SEQ ID NO: 13840 - DNA, 496 bp, Homo sapiens
aacacaatacctttctccaaagaaattatggaagtactagcgtaagaaatttgactttttttggggggaggggggagggatagcattaggatatatacctaatgctaaatgacgagttaatgggtgcagcacaccagcagggcacatgtatacatatgtaactaacctgcacattgtgcacatgtaccctaaaacttaaagtataataataataaaattttaaaaaaagaaatttgacttttttaaaaaaacctcttagaagaagatataggataacatccttatgaccttgaattcagggaggctataataatttacaggaagcatacattgagggaaaagattaatacattcaaatacattaaaaattaattttattcattggaagatagaatagccaggcgcagtggcacttgctttgtagtcccagctacttgggggctaagacgggaggactgcttgagcccaggagtttgaggctgtaatgtgctttgat

SEQ ID NO: 13841 - DNA, 440 bp, Homo sapiens
agtcccaacaatgggctgaggtagatctctggtgactcagatactccagtgatgagtgtggtctgcaggaggtgtccaggggagcaggaggcacacggcaccaacttggaaagttaatgaatgagtttagtgatggacacacaaggaactgttaacatgttttagaaaacttacttggcctcagcactttcttctccttttaggctgggtgcggggtgagacctcctcctcctttttccttcaccctcagttgtattttattggattacaagtttgtatttattttgtattacaagatcctgtcttctgttcctgttttggccactgtctatgccaggctgctattagagcctgacagcttcaccctaaataaaagaaaaccttttatgtgtagtttaaaaaaataaacaaaaacctctgtagacctttttaaaatctac

SEQ ID NO: 13842 - DNA, 413 bp, Homo sapiens
tgaccactttttcttgttttcctccatctactatccaaaagcatacagcaccagcccctgcagaaagagattagacatgatacaatatctaggagcttatttaacaggaaagtacatagtgacagaacaacaatgatttatttgtaatggtggtgcttaatgagtcgtgatttattcagatgacctcccctatgttcccatgtcctcattcctcccagctcatacccacagccttctcttttcagcatagttgtggggaatgaaggctgatgactgcatttggttttaactatgcattaatgttggaatctgatattctaggaaaatttggttattctgattggctatattcacttccaagattctacagttcaatcaatgtttcactgaagtaagtcttgagtattcttaaa

SEQ ID NO: 13843 - DNA, 559 bp, Homo sapiens
ggtttcaccatgttagccaggatggtctcgatctccttaccttgtgatccgcccgccttggcctcccaaagtgctgggattacaggtgtgagccaccacgcctggctgaaatacataatcttaaaagaaaacataagatactttattttaatatacgtgactaaatgtaaaacctaacttattttctgttatctatttatttttactttcagtaacactttttttattttaggtagcattcagcctagaggcaactgctgtttgttaaatatttcctgttcatatattttgcacattttcttatgggttagttttcttctcattgttttgggaagttcttaatatatttggggtatttatctttcattcgttgtctgtgtaacaaataacttctgccatatgggttgtctgcacattttttggtgtcttttagtaaacaaggtttttttgttttgtattgttttgtttattgtaaagatttttaaattttaatggagttgatttcttttctcattcaagcttttgagaataaattggagttgaatttttaatggttttt

SEQ ID NO: 13844 - DNA, 443 bp, Homo sapiens
agcaatcccattactgggtatatactcagaggaatataagtcactctactataaacacacacgcatgcaaattttcattgtagcactatttacaatagcaaagacatggaatcaacctaaatgctcatcaatgacagatcggataaagaaaatatgcatcttcaacctttctggactacagcacctgccaactgacccccacatcatggctccaacgctggcttcatcacatatcttctctctcagtccctttggctctcagggtgcaatagcttaacaaaattgctgatctaggtgcctcagcattgtttctttgtcatagtctctgtattatcttattttgagccattcttttcctgcaaagatcctaactgaatgagataactacttcataagctatttgtaaggtttaaataaattaatgcatatttaatacatgaaac

SEQ ID NO: 13845 - DNA, 386 bp, Homo sapiens
tagtcaatgggatgtaagcagaaatgatgtgcgtaacatcaagaatcagtttttcagagagataatttgcttttcttttctccttcttgtctttgatagcatcttcaacctttctggactacagcacctgccaactgacccccacatcatggctccaacgctggcttcatcacatatcttctctctcagtccctttggctctcagggtgcaatagcttaacaaaattgctgatctaggtgcctcagcattgtttctttgtcatagtctctgtattatcttattttgagccattcttttcctgcaaagatcctaactgaatgagataactacttcataagctatttgtaaggtttaaataaattaatgcatatttaatacatgaaac

SEQ ID NO: 13846 - DNA, 404 bp, Homo sapiens
tgtgtgtctctacttattagcttgagaaaccttgccagaggtccttggacgctttctacctatttgcccaaattagatatatccctggcaaggtgaatgagtgccttagatcagtcccaattcccttctgtaggcctgaagctagagagacttagcaggaagatggaacttacccaaaagtagagctctgccagcatgggaaaaaggaaaagtgcctgcaacaggaaaaacaacaaagagagagaggtggagaggaacacgccaaagaaagagagagagcccacactatcctaagctcctgaatgcactgtgacatccagatgtcctggggaagacataaacacatcatacagcacccacaggaacctcaagagactggagttaataaagagattaaagagatt

SEQ ID NO: 13847 - DNA, 173 bp, Homo sapiens
gcaaactacaactcagctaatagctctgtgtaaatatcaacctttgtctaaagaagaaaacttgtctcttcaggcagaactaagtaatagtgatgccttttattaaacttatttcataaaaggcatcaaaggggagaaactgaggcagaaatttaaataataataataataaa

SEQ ID NO: 13848 - DNA, 303 bp, Homo sapiens
cagatgggcagaggcagagaatgccaggtacagctgactcctagagaattcatcacatcaactccacttgcctttgcaggagatgaagataagcaggacccccattgctgctgtttcccccatttccagccccatcaccctgagctttttcaagtttaggtgggaagatggagagggatgaatgaggggaggtgtgtggctttaatacaccttggttttagcttctgcatctattccttttctcttctatagcagacataagtgggaatcacttccctcttgtgctaatttaaaggcaatttt

SEQ ID NO: 13849 - DNA, 488 bp, Homo sapiens
agtaatctccgattttaggcctgaaggataagcacagttagcacataggctccttatcctctaattgcccattgtccattcttccctgctttactttgtgtcttgaggggctatgttctgtgcacgaattaccagtgcatccttgccttatgacttctggttgggttcagccaattggagggcctcatgagagatcagagggcagaaagatagagagtctgcacacttattacctttgctcctttcctgctgggctgcaaattttagcagctgtcaggagaccctgttggatagtctccttcccgttggttgtaaccaggtctttcccatggctagagtcctcatccaggttccaatgacacttgtcttatgtcttgcggcctcgagatagtaatgttctcctatgttgctagtccattggcacctcatcaaatattattgggtttcctttttagcccctcctgtttctccagaaataggccatttaa

SEQ ID NO: 13850 - DNA, 834 bp, Homo sapiens
gtggactctcctaaaattgtgaatgaagaaaacttacagccaccacagttcagttctttaactatcattgtaataatggaagacaaaaatccagctccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatggtgagtggcattagtttcccagctatattcgcactggtaataaagagcatgtgcatgccaccagcagatgagatggggctcagggggcaaacaaactataaatagaagtctttgtttatagactagagcctactatgttacttatattttactcttaaaatgggatttcacataaaaatcagacagtctaaaacctgtga

SEQ ID NO: 13851 - DNA, 4022 bp, Homo sapiens
gtggactctcctaaaattgtgaatgaagaaaacttacagccaccacagttcagttctttaactatcattgtaataatggaagacaaaaatccagctccgggagaacagcatgtacaccagcctcagtgttacagagtgtgggtacatcaaggtgaatggtgagcagaaactataacctgttagtccttctacacctcatctgctacaagttctggcttagacatggatattctttgtgaagaaaatacttctttgagctcaactacgaactccctaatgcaattaaatgatgacaccaggctctacagtaatgactttaactccggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatgggtaccggtggcctctgccgagcaagctttgtgcagtctggatttacctggacgtgctcttctccacggcctccatcatgcacctctgcgccatctcgctggaccgctacgtcgccatccagaatcccatccaccacagccgcttcaactccagaactaaggcatttctgaaaatcattgctgtttggaccatatcagtaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgccgtaaataaaaatagctataaatagtgaaaattttattgaatataatggcctcttaaaaattatctttaaaacttactatggtatatattttgaaaggagaaaaaaaaaaagccactaaggtcagtgttataaaatctgtattgctaagataattaaatgaaatacttgacaacatttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtg

SEQ ID NO: 13852 - DNA, 3452 bp, Homo sapiens
aaatttggcataaaaaataaagctagatttattatacttctttataagggttagctatatagggcaatataacatacaagtaactacataatatatacttacaaaacacatatgtaagtccaaaggaattttaaattctcaaagtatgttaagcttttaaacgatgatataaaatcttttcaatagccaatattatgtgatgatgctcttgccttcatatacttaattccttaataatcatgtttcattttctgttcaactccaggtatatccatgccaataccagtctttgggctacaggacgattcgaaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacaataccggctttggcctacaagtctagccaacttcaaatgggacaaaaaaagaattcaaagcaagatgccaagacaacagataatgactgctcaatggttgctctaggaaagcagcattctgaagaggcttctaaagacaatagcgacggagtgaatgaaaaggtgagctgtgtgtgataggctagttgccgtggcaactgtggaaggcacactgagcaagttttcacctatctggaaaaaaaaaatatgagattggaaaaaattagacaagtctagtggaaccaacgatcatatctgtatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgccgtaaataaaaatagctataaatagtgaaaattttattgaatataatggcctcttaaaaattatctttaaaacttactatggtatatattttgaaaggagaaaaaaaaaaagccactaaggtcagtgttataaaatctgtattgctaagataattaaatgaaatacttgacaacatttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtg

SEQ ID NO: 13853 - DNA, 1071 bp, Homo sapiens
gaaatttttgttaatttaaaccataactgttagatccaacaatctaaaattaatcaaagacatttgaactgatgaaatgtatatagagccagtatgctaaagcttatcatctattcagttaggaagttatttattttacccatattgtgggcaaaaacaatatatacttattgatagcttttaatatatctgagtttgcatactttaggaaggtaaaggacagagaagtcttgacacacattgtagtagtgacaattatgatttcctacagacaagataatctccaacacatacaaacacacacaggttaagtaaatgggatttattggccaggcatgatggctcacgcctctaatcccagcactttgggaggccaaggagggtggatcactcgagcccaggagtttaagaccagcctgggcaacatggtgagacctcatctctactgggaaaaaaaaaaaaaattagccaggcatggtggagtatgcctgtagtcccagctacttgggaagctgatggggggaggttggaggatcacttgagcctgggaggtcgagactacatttatctgtgattatgccactgcacttcagcctgggtgacaaaataagaccctatctcaaaaaaaagagagaaagtaggaatcattatttcccacagttgccgagaagtgattaaaaatttggcccttaaaataaggtcatggtttgaagacacatgtttaaagcatttaagagttcttaacaatgtttaatggaacctgcagtatatgtgatgaggatgttcttgatatctgctggcattcttttcccttttacataatataaaatatttcccttatcttttaagtattatttttaaaaatgtgattagtttcccattataagcagattattctccctccattttatacaaaatcacgcattttgtataaaatgccaacagcttcagtatgagagagtaaaggttaatgaaatcaaaattcggcagttggcaaaggcatggtttctctcctaaactagaaatgaagtgtcttattaaggtgacatgcagttcctgaagtgtcaacgt

SEQ ID NO: 13854 - DNA, 260 bp, Homo sapiens
gagatcgtgccattgcactccagcctgggcaatacagtgagactcagtctcaaaaaaataaaaaagggatgtgccctatgtgatgtgatgtgatgtgatgtgatgttctcttcacaggctggaactttattatgtttacagatgcattacttaagatgaaatggaaggcttctccaagttagataaacaatcattttacctcctgcagaagtaaaattacagtatgtttagtatgtttaatgaggtctttaaaagtctgc

SEQ ID NO: 13855 - DNA, 308 bp, Homo sapiens
aagtagttataatggtgcgtggtatgtattaaatgttgaatgaatgtgaattatcatcattagacctcaggcatcgaagcacagaagtcactattaaattggaatttattaaaaagtggaaaaatgtggaatttgaaagtgaatctaaaggtgaaacatagcaatgatataaagtttatacctagcctataattgtttacctctcctattatctaaggatgttatgtttcgtacatggtgtttggaaatgtaataaacaatagtcatgatgcagagagtcacaatgacagcaaagtcccagagttctg

SEQ ID NO: 13856 - DNA, 451 bp, Homo sapiens
ctcacagtcccacttactttgctctaagcaacactgatctccaaacatgctgtgcatagtatttcccttacacggcacacctgcaaatttattctgcactttcaaatataacttaaaacaatagcactacatgaaatgtgccattttcccaagaagattgtagactctttcccctgtactcgccataccttacacaattctccctttctgcaaataccaaattatgtttcttggtatagtgatcttcccatgggcctacaaaatccatgtggtcaaatgacatgcctttccgttattccttccctagaatcttctcctatgcctgacatccatgtttaatgaatgatcagacacaatataggaagagggatgctgacttttatgtttatgcctctattctcaggatctgaaacagcacctgatatttaacaggtgttcactatgtgtctgt

SEQ ID NO: 13857 - DNA, 625 bp, Homo sapiens
ggttttaccgtgttgcccaggctggtctttaactcctgggctcaaacaatctgcctgcctcagcctcccaagggattacaggcatgagcaactgcccagcccaggattattgtatgtatttttgctaggggattccctggaatgctgcttagttcaagatatttgtccatttcctctgaagaagctagggtgtacaggtgaggaaatatgacaggattattttcttttttaaaaatctcttgtaaaaagacataagggtctgctaaagaaagttgacagactcttgttttctggaggttaaccttgtctctggtccaaattagagtcaggcatttaggatgaggtctgatgatggttcatagaattttgtccacaatctgttatgaaccctggactggtgagccttgttatctgtggccaacctagggaattttaatcttatggaattgaaaaaacaaggaacaatgtttgtgagggatttattaatttcttcccagatttttctttttctcccctgttgtctctcatagtttttccagccctcctagtcacaatccccagaggcagctacttcaattcttctggctacctagttttactttactctgttgtttaaaaaaaaaaa

SEQ ID NO: 13858 - DNA, 207 bp, Homo sapiens
ctagtattgaatataagttttttattaatattgaatagattgcctttcttagtactgtctattgttagaagaagccccctaataaagagactgaagtaattgtagaagaaactggatctctctaagctattaatcatgttttctgaaggaaggagagtcaacattgtggcctcatgccttacaagcatttattataaacgtgaatag

SEQ ID NO: 13859 - DNA, 299 bp, Homo sapiens
aaaagggatttatgaatattttttaaagcttaaaaagcccacatacttatcatcgaattgtctgcttacgataggagctggaagagtcccttatatccactcaactgtacttacattttaaatggttgttttcctttctcttacactactacaagagaaaggaaatgcctaggcaaataaactcagttaaaataactttatggttgtgacacagtttgacaaaagcaaaggaaattcagagtcactgctcacactgtatcctcagctgattccaactgtggaaaataaaatgctttaaa

SEQ ID NO: 13860 - DNA, 469 bp, Homo sapiens
taaattcagatccatatttatagttttgctttagaattggataaagaccatttgtggtctcaatatttgggacttgctaaaagtaggtaccttgatgcattttggaggcacttcttaactcggattcctgagtgtaacccaagtattaactctatggccatagaatgccgacagaagagcagaagaaacttccacttttatggttcctgggcatgcaataagactctcaagaaattagatagccaaatcagtgtgccatttctcatcaccagaatagcaagcttcctggtctgagaaccccaagggaaagtctaaactccattttcgcaatcacttttctattttcctgacttttcactgaattgtactcacgggtataaatctaacctttgatctacgtggacctcatgaataagtacaagttctacttgtttgggattttaagaactagcaaaagcaaacaaacaag

SEQ ID NO: 13861 - DNA, 427 bp, Homo sapiens
gatgtaatacataaatatgttttaggagtggggagggtaaagagacctaaatggaagcaaagtttctgcacttcattcaaaatataaattgtataaattgttgatatcactagactgtgactagttatatatttatattgtgatagagtgaccactaagcctatacaaagtgatatgttcaaaaatactatagctaattcaagatataattctacagaatgtttaagaaactcacatgaggccgggcgcggtggctcacgcttgtaatcccagcactttgggaggctgaggcgggcgaatcaccggaggtcaggagttcgagaccagcctggccagtatggtgaaaccccatctgtactaaaactacaaaaattagccgggcatggtagctcatgcctgtaatcccagctactcgggaggctgaggc

SEQ ID NO: 13862 - DNA, 1293 bp, Homo sapiens
cagcctcctgagtagctaggactataggcacgtgccaccatgcctggctaattaaaatttttctttgtagagacaggggtctcactatgttgcccaggctggtcttgaactcctggactcaagcaatcctcctgcctccgcctcccaaagtgttgggattacaggcatgagccactgcacctggcctgttttctccgttttaatgaagtgagaaatgcatctcaatgggataactgcaggtcagggctctggatcaggatgatatcaagtgatctcacactgaaccaatataatttccatgtggaaccaaagactcactgggagttttatgtggcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagac

SEQ ID NO: 13863 - DNA, 800 bp, Homo sapiens
cagcctcctgagtagctaggactataggcacgtgccaccatgcctggctaattaaaatttttctttgtagagacaggggtctcactatgttgcccaggctggtcttgaactcctggactcaagcaatcctcctgcctccgcctcccaaagtgttgggattacaggcatgagccactgcacctggcctgttttctccgttttaatgaagtgagaaatgcatctcaatgggataactgcaggtcagggctctggatcaggatgatatcaagtgatctcacactgaaccaatataatttccatgtggaaccaaagactcactgggagttttatgtggcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggggggttctaagacccgttggtgggtagccaattataataactatcatgtt

SEQ ID NO: 13864 - DNA, 1020 bp, Homo sapiens
  misc_feature (116)..(116): n is a, c, g, or t
gttagctgtgtcgggaagacatccatgaagtgagatgcaaatgtccagttacatggtgatgaatttgtcctgtttggatgcaacatttgtaatggtggctcgtgattctgaaaatnaagggccggcatttgtaaatccactcatccctgaaagcccagaggaagaggagctctttagacaaggggaattgaacaaggggagaagaattgccttcagctccacgtcgttactgaaaatggcccccagcgctgaggagaggaccaccatacatgagatgtttctcagcacactggatccaaagactataagttttcggagtcgagttttaccctctaatgcagtgtggatggagaattcaaaactgaagagtttggaaatttgccaccctcaggagcggaacattttcaatcggatctttggtggtttccttatgaggaaggcatatgaacttgcgtgggctactgcttgtagctttggtggttctcgaccgtttgtggtagcagtagatgacatcatgtttcagaaacctgttgaggttggctcattgctctttctttcttcacaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggagagtccatgttgtacttagatgggcagcggcatttcaactccatgagtggcccagcgaccttgagaaaggactaccttgtggagccctaagaacaccacatttgttgaaaactagcactctacccacagtgacgtggtatctgatgaagacctgatcgagtgtattgattttagtattgcttcgtgtcctccacacaggaggaggatgtattcagcctttaggatgatcagaaaagcagaaagagagagtggccggatggggctgaggggagaaagaattattaaacaataaatactttcaagac

SEQ ID NO: 13865 - DNA, 330 bp, Homo sapiens
ttttgatagccacacaacctcaggcttctttttggcaatacagtttcagtgtgtatcttaaaatttttaatctaagaattactgatatttaaggatgttaaaagggcaaccaaataaagtcctttgttctgataattgaaagaattttttttctgttttaacacctataaagaaattctacaactgcttaccttcacctgttctaatatttaagcttcctagctgttaggaagttcttctttatatcttacctaaatacagcctaaatgcagaactctttgtcgtagcttagagtcatgtatgaaaatcaaggacagttggtcatgttac

SEQ ID NO: 13866 - DNA, 1196 bp, Homo sapiens
cacaccactgacttcaatgactataaaattagccagcgacttccttaatgctaacaacaacccatgaagtcaggacctaacagaaggaaacaggactcagagagggaaggctgcttctctggggtcactctgtgtgcaccagggctctgactggtgccctgtccctcagtcactactgaggctgatagtggcagtgcccagcagctgacagacgtagaatattttatataggttgggccccatgctcaatggtgtgcacatgagctcgccaaatccccagatgcacccagtgtggtgagctctgccataagccccattttataggggatgacactgagccctagggagggaaactgctcactgggcttctgagcaggagggtgtcaagcaggcctcagctctccacctgcccatgcttgcaaggattgcctggcacttcactgttcatgtatcttggactgtgtgcacacaggctggtctacccagacaccctcctgaaggaaaccaaggactggcaacagctgtggtccccgaggaggggaaacgggacagcagctagagggatgctgaagtgtccatcagtgccatttagtgtacacactgtggtctggtgtcccaaggctgatggctgtgaccacgtcaatcagctcctctgtgaaagtgtcccgttgggatattcacaaacattcacagaagagagacaggagcaagtctttttcaattgcacatgtctgactcctctcatagagttaggtccctctctctctgtcttctgtcttctcttaccttcccctgcttggtttgcttacttcccctttagctctcatctcacatccagtcccagctctccacagtagccatgctggtgtgctagatacgaccctagacatagtagctgggtaaaatgtgcagcattcctgtgggtatgtgttttcaaacatttgcttaaatttggccaggcatggtggctcacacctgtagtcctaacactttgggaggccaaggtaggggtgcgggggagcggacttgcctgaggtcaggagttcgagaccagcctggccaacatggcaaaaccccgtctctactaaaaatacaaaaattagtcaggcgtggtggcaggcgcctatatcccagctactcgggaggctgaggcaggagaatagcttaaacccggggggcggaggttgcagtgagca

SEQ ID NO: 13867 - DNA, 1282 bp, Homo sapiens
cacaccactgacttcaatgactataaaattagccagcgacttccttaatgctaacaacaacccatgaagtcaggacctaacagaaggaaacaggactcagagagggaaggctgcttctctggggtcactctgtgtgcaccagggctctgactggtgccctgtccctcagtcactactgaggctgatagtggcagtgcccagcagctgacagacgtagaatattttatataggttgggccccatgctcaatggtgtgcacatgagctcgccaaatccccagatgcacccagtgtggtgagctctgccataagccccattttataggggatgacactgagccctagggagggaaactgctcactgggcttctgagcaggagggtgtcaagcaggcctcagctctccacctgcccatgcttgcaaggattgcctggcacttcactgttcatgtatcttggactgtgtgcacacaggctggtctacccagacaccctcctgaaggaaaccaaggactggcaacagctgtggtccccgaggaggggaaacgggacagcagctagagggatgctgaagtgtccatcagtgccatttagtgtacacactgtggtctggtgtcccaaggctgatggctgtgaccacgtcaatcagctcctctgtgaaagtgtcccgttgggatattcacaaacattcacagaagagagacaggagcaagtctttttcaattgcacatgtctgactcctctcatagagttaggtccctctctctctgtcttctgtcttctcttaccttcccctgcttggtttgcttacttcccctttagctctcatctcacatccagtcccagctctccacagtagccatgctggtgtgctagatacgaccctagacatagtagctgggtaaaatgtgcagcattcctgtgggtatgtgttttcaaacatttgcttaaatttggccaggcatggtggctcacacctgtagtcctaacactttgggaggccaaggtaggggtgcgggggagcggacttgccatgttggccaggctgatctggaactcctgacctcaagtgatccactcgtcttggcctcccaaagtgctgggattacaggcgtaatcactgcgcctagccaagatttggtttttttagagggctttacttccatgtgactagtatcttgtactgttggacatttttaccatgtgtatggattatacttacaaaagaaaagaacaacataaataaaaataaactaaaagttggaggaagtaaacgacaatcta

SEQ ID NO: 13868 - DNA, 226 bp, Homo sapiens
gcattcttatttttcattctaatggaaaggattattcttcctgaacccatccaagccttttattatgtgaattctttagtgtattttaattgtttgccttaagttatattcaaaatgcctccttttaatttagatgtttctatctttggcagggtttctattcccaattcaagtatgagaattactttgccttctttcttttgtcttctgttcaaatcttttaaat

SEQ ID NO: 13869 - DNA, 473 bp, Homo sapiens
aaggcatagtaagttttcactgaaaacctgcattcattatgaaaggttatattctaaatgacaaaatcagtaagtgaatattagaagattagaaatgtggtcttaaaacctaggaattttttcttctaaagatgaagatgtgtatggagagcgaaacacttgtctttctaggcaatcatattgatcctgctcctcaatttctagtgatgaaaattaatgtaaaaggtttagtttaatcaactacagttttaagttacagttgaagaaagtagtatcagaattctgttttttattctgtaaatattaatgcttaggatatagaaacagtttattcagggttttcctacactgcgtttatcatttaaaatattgaataagctgaacacattagtgtataggaggctgaggcgggaagatcacttcagcctgggattttgagtcaaccggcaactagaccccatctctaaaggaaa

SEQ ID NO: 13870 - DNA, 1921 bp, Homo sapiens
tgagacaaaattctgctgtctcgcccaggctggagctgcagtgagctatgatcacaccactgtactccagcctgggcaacagagcaagaccctgtctctcaaaaagagagaaaaagaaagaaaacatttgagctccatagattgacattctgatttgaacagtttcccatagagggagaattgcggcgaaagaggcaaggcctgcccacaatgcatggtctgggacttagctgatgaagtgctctgcaccacccagcttcgaggagatggggactggggtttccccttgcttgacatcttaactacttcactgcaggaaaggggaggagggacaagaggaggaccaattccccaagggacacggagacccacattaggttttggaacccacgcctggtactatctgaatttaaaagccttgcttgactcaggcggggctgatcaaaggccatttgctgttttagagtgttcctatgtgtgcttggcagacagagttgtctttttattgcttccattcccactaagacctccatccccccactgcccccccaaccccttggtgagcttggtgagatgtgttttttttttctttttttaattttaagttccaggatacatgtgcaggatgtgcaggtttgttacaaggtaaatatgtgccatggtggtttgctgcacctatcaacccatcacctaggtattaagccctgcatgcattagctgtttatcatgatgctgtccctcctgatgagatggttttaagttggcaccagcacctgtttctcatgccttgcgtatgcagcaggaactgtgaactagggacaggttcatgccctttggccactgcagacgtggagctgtggacgccagtacttgtgtggagagtcggtgtctgttggctgtatctcagctttcttttcagggcagacctgatacaggtgttctaggtgggaaaagccttagcacttgttgtgaactattatattgttactctctggaagggaaggtggaaaggggaatctatgccagtgagcacaacacaggccgcatatggacacacatgaggtcgctcggcatgctcttaggcccagaggagacagaatcagatactagcctatcctctggctgctcccaggctagcagggaggtaggtgtctaaaccaggatgtgagctagaggggactatagccgtgcacaggaggggcacagaggacggagcaagcagggcaggcttcacggaggagggcttgtgagctgaatcttgagagagaggagatcctccaagttgagggaactgtgggagcagttagacagcttggattttggggggtgtagcacattgctccttatgggctggggtgtaatgtgcagaggagggcagagggaagattgatttgctcattatgcaacaaatgtctggagctccagtcctgaaccaggcccaagctggggaatagcaactcagtccctgcccttgtggagtctgtggctggcaggggcatgttcattaaacaacttattgcatgattcactacttttctttttctttctttttttctttttttttgtgagacaggatcttgctctgtctcccaggctggagtgcagtggcacaatcaaagctcactgcagccttgaattcctgggctcgagcggttctcctgcgtcagcctcccaagtagctgggaccgcaggcacacatcactgtgcctggctagttttttaaattttttgtggaggtgggtatctcactttgttgcccaggctggttgaactcccgtgagctcaagtgatcctcttgccttggcctcccaaagtattgggactacaggcgtgagccacagtgcctggcctgattcatgattgaagtaccattaccataaatgctatacatccatgcattggatgttaaagggatcataac

SEQ ID NO: 13871 - DNA, 2504 bp, Homo sapiens
ctccatgtttcgatttccccatctgtagacgggaagaatgaaggcatgtggtgggaagcagtgctgattagggcttaagagaagaggcttaggaggcagacagtcttagggtttctttctggcataatagtttcctagctgcttgaccttggggagttcacttaactttgttagtcctcaatttcctgatatgtaaaatgggataataccatatgagcatctacctgacaggattgttgtaatgtttacaggagacagtgttcgtaaagtacaccgcctgggaggtggctagcacattattcctgggggctacttttactattaacagctccatagtgatttgaccaaaggtttctgagagttgagccaagatgcggactagatgggaccacattgagaaaacatttgaggctggatgcagtggctcacgcctacactctgggaggtagaggtgggaggactgattgaggccaggagttggagaccagcctgggcaacacagtgagaaccctctctacaaaaaatacaaaaattagccaagtgaggtggtatatgcctgtagtcccagctactcaggaggttgaagtgggaggatctctcgggccagggaggttgaggctgcagtgagctatgatcacaccactgtactccagcctgggcaacagagcaagaccctgtctctcaaaaagagagaaaaagaaagaaaacatttgagctccatagattgacattctgatttgaacagtttcccatagagggagaattgcggcgaaagaggcaaggcctgcccacaatgcatggtctgggacttagctgatgaagtgctctgcaccacccagcttcgaggagatggggactggggtttccccttgcttgacatcttaactacttcactgcaggaaaggggaggagggacaagaggaggaccaattccccaagggacacggagacccacattaggttttggaacccacgcctggtactatctgaatttaaaagccttgcttgactcaggcggggctgatcaaaggccatttgctgttttagagtgttcctatgtgtgcttggcagacagagttgtctttttattgcttccattcccactaagacctccatccccccactgcccccccaaccccttggtgagcttggtgagatgtgttttttttttctttttttaattttaagttccaggatacatgtgcaggatgtgcaggtttgttacaaggtaaatatgtgccatggtggtttgctgcacctatcaacccatcacctaggtattaagccctgcatgcattagctgtttatcatgatgctgtccctcctgatgagatggttttaagttggcaccagcacctgtttctcatgccttgcgtatgcagcaggaactgtgaactagggacaggttcatgccctttggccactgcagacgtggagctgtggacgccagtacttgtgtggagagtcggtgtctgttggctgtatctcagctttcttttcagggcagacctgatacaggtgttctaggtgggaaaagccttagcacttgttgtgaactattatattgttactctctggaagggaaggtggaaaggggaatctatgccagtgagcacaacacaggccgcatatggacacacatgaggtcgctcggcatgctcttaggcccagaggagacagaatcagatactagcctatcctctggctgctcccaggctagcagggaggtaggtgtctaaaccaggatgtgagctagaggggactatagccgtgcacaggaggggcacagaggacggagcaagcagggcaggcttcacggaggagggcttgtgagctgaatcttgagagagaggagatcctccaagttgagggaactgtgggagcagttagacagcttggattttggggggtgtagcacattgctccttatgggctggggtgtaatgtgcagaggagggcagagggaagattgatttgctcattatgcaacaaatgtctggagctccagtcctgaaccaggcccaagctggggaatagcaactcagtccctgcccttgtggagtctgtggctggcaggggcatgttcattaaacaacttattgcatgattcactacttttctttttctttctttttttctttttttttgtgagacaggatcttgctctgtctcccaggctggagtgcagtggcacaatcaaagctcactgcagccttgaattcctgggctcgagcggttctcctgcgtcagcctcccaagtagctgggaccgcaggcacacatcactgtgcctggctagttttttaaattttttgtggaggtgggtatctcactttgttgcccaggctggttgaactcccgtgagctcaagtgatcctcttgccttggcctcccaaagtattgggactacaggcgtgagccacagtgcctggcctgattcatgattgaagtaccattaccataaatgctatacatccatgcattggatgttaaagggatcataac

SEQ ID NO: 13872 - DNA, 532 bp, Homo sapiens
ctccatgtttcgatttccccatctgtagacgggaagaatgaaggcatgtggtgggaagcagtgctgattagggcttaagagaagaggcttaggaggcagacagtcttagggtttctttctggcataatagtttcctagctgcttgaccttggggagttcacttaactttgttagtcctcaatttcctgatatgtaaaatgggataataccatatgagcatctacctgacaggattgttgtaatgtttacaggagacagtgttcgtaaagtacaccgcctgggaggtggctagcacattattcctgggggctacttttactattaacagctccatagtgatttgaccaaaggtttctgagagttgagccaagatgcggactagatgggaccacattgagaaaacatttgaggctggatgcagtggctcacgcctacactctgggaggtagaggtgggaggactgattgaggccaggagttggagaccagcctgataacacgtcgcgagggtaccggctcgattctatatgagc

SEQ ID NO: 13873 - DNA, 546 bp, Homo sapiens
gtgagaccaggttgggcaggaagtgcattcctcagcagagatcatatctaaaggaaggcagcagttccaagggaaatggggaaatggctctgggccccggcggatgtcagcaatgggcattgccatccttcccagccagcccacccttggcaagagcagtgcagaaaaagattctgcaatccaaaacaataaactctgaccatggagaaataaaactggggtcggggggacagtagtgatgcttatttaaaaaacggactcttgccaggtattgtggctgacacctgtaatcccagcactttaggaggccaaggctgggggatcacgaggtcaggagatcgagacaatcctggctaccacagtgaaaccccatctctacaaaaaataacaaaaaatgccagccacagtggttcatgcctgtaatcccagcactttgggagccaaggcaggtggatcacctgaggtcgggagttcgagaccagcctgaccaacatggtgaattcccatctctattaaaaatacaaaattagccaggcatggtggtgc

SEQ ID NO: 13874 - DNA, 421 bp, Homo sapiens
ctggggcgcagagctgggaggtctggctccgcgggcggttggtggcgacccggggctccggcgcgcggggggcgagtgttctggaggtgtctagagtgaaagaggtgagggcacctcgtgtcctcactaagggcgacctcagaggagctaggcatggccgggaaccgacggcctaggccacagcctgggctgcatgcacttttttagcacactgcgtttcccaaaaggaaggctgggaggaaaagcccatcgctaattactactctagggccccagcccgtgccctgtccttgtcctcccaaaagaaaaatgacctcaacttaatattttgcatttcctgactctgtgccctacattgctttaaacggtgtatgcacacatactcatacaatcctaacaaggtgtgagttatgcaccactt

SEQ ID NO: 13875 - DNA, 362 bp, Homo sapiens
ccatcctccttctagtggggtggtacaggaatgagttgggaagtcctgaataggaaattccacatttagaaaatgtaccttaacatctcagttccactcagggacaatctttgaggactagtcattaggctgagctcacaggggggacctgggggaggagctgccaggatggtgtaggcatatgcatacacagaatctcacccttttttgggagagttgcacagaaggatctgctgatattgcatattcaaaactaggacattcctgatgcttcgtcattttctcaattcaaacaagcaaaagttcacatgtacacgcttgcaccacccccttaaatgtgttaggaggaaagagttcataat

SEQ ID NO: 13876 - DNA, 238 bp, Homo sapiens
gctttttgtgtgaattgaagacttaaagaagtatttgtaaatatgtctgtataagaaccaccagaaagatgaagatgagccgtaatagaaatatcaagaggctacaaagtcttagcaaattataattgctaatggtacattatgtggtgtttagtatcacatttagaatgtagtcatttgttaagtttttcatggggtaaaagaaagaatttattccaagaaaattttggaattttaa

SEQ ID NO: 13877 - DNA, 416 bp, Homo sapiens
acatacagagaataagtttcaagtatgcggaagccggaaggtcctgtgtgtgtctggttagaaggcttcaagtcaatctctttgggaaagaagctttgccttcctcatgagttcagacaagaaagcagaactcgtaaaggtctagcaaaggcgactgcaaagggccaactccacacagctcagagtccggaggaaaggaaacgctccttctggacaaagtataaagaggttaggaaaatttcaaatttctctagttaaaatctgccggtattgaagaaggtaaattctgttacaatgacaaatcaataaaatgctgcctcaaaagacttattacgcttctatattggggtagaaaaaagaaagggaaaacattggtgtctaaaaataaggaatggtatgaacttaagtctgactct

SEQ ID NO: 13878 - DNA, 421 bp, Homo sapiens
ggaaaaatagaattcattatttgtggttaaaatgaagtgaaatatggcgggtctgaatgcagtggtgcttacaactaattgatcacaaccagttacagatttctttgttccttttccactcctattgcttcacttgactagtcataaaaaaatgatgtgaaacgtaattctaggggtgaaaaaagatttttttataaccatgatccgttactttatagaaaatttggttccaataactgcttttcaagtttttgttcttttcagttttagtacttattagtcgccactgccattataatataagcttcccaaaatgtaactgtcattgtttcacatcccctgctgatctgcagcactccccggcgcctaccaaattaaggaatgcctcgcccaatgttcagctgagacattgctgtttgta

SEQ ID NO: 13879 - DNA, 367 bp, Homo sapiens
tttttttttaagactctcactgtcacccaggctggagtgcaatggtgcgatctcggctcactgcagtctctgcctcctgggctcaagggattctccagcctcagcctcctgagtagctgggatcaaaggtgtacatcaccacacccagccaatttcatattcttggtagagatggggtttcgtcatgttggccagacagatctcgaactcctggcctcaagtgatttgctcacctcggcatcccaaagtgctgggattacaggcatgagccactgcacctggcttgtcttatttatgttatgtctacgtgaaacagcccagtggtcagcacacaaaggggtccaaacgtgaaaggaaagagcaaaca

SEQ ID NO: 13880 - DNA, 657 bp, Homo sapiens
gtttcactgcactttgctttattgtgttttgtgaccatgtgttttacgtattgaaggtttgcggccaccctgcaataagcaggtctcactggcaccattgttcctacagcacgtgctcacttcacgtctctgtgtcacatttcggtcattctcacagtattttaagatttttattattgaatctgttgtggtgatctgtaatcagtaatctttaatgctactgttgtcattgttttgggaaccacaaatcacaccaggataagacagcaaacaattgacaaatgcgtttgttctgactgcccaaccaacgggccatttctctttctctttttctcaggcttctttttattaatattaaaatgtggccaattaataaccctacaatagcctctatatgttcatgaaagaagagttgcatgtctgtcactttaaaccaaaaggaagaaataattaagcttagtgaggaaggcatgctgtaacaagacaggccagtagctagacctcatgcaacaaacacttagccaagttgtgaatgcaaacgaagtgttctggaaagaaatttaaagtactgctccagtgaacacatgaatgataaaaagctaaacaatcttgctgctgttatgaagaaagtttaattggtctagatagaagatgaaa

SEQ ID NO: 13881 - DNA, 705 bp, Homo sapiens
attttgtgaggaactgccgtactgttttgtgatagcagcttgttaacagaaagactaaactgtaaaatattttaaagaggtttattttgagccagtatgagtgatgctggcccctcaacgctttatacttcaccagaaatttatttctcactattcttgaggctggaaagtttaaagatcaaggcaccagcaagcagatttggtgtctggtaaaagacctctttctgattgttagaggtaccttctaactgtagcttcacagagtagaaggggagaatgagctccctcaggcttcttatatactaatcccattcgtgagagttctcatgacctaatcacttcccaaaggccccacttcataattccatcactcaaaataagaattttgaggaggtacaaacattcagacaatcgcagacccttaagaactagcttgtctaatttaaagatcacaatttgagtatttagtctagattgttaaatgactattacttaaagctgtgcagaaatccaaaggaagtataagacatggtcttaggaaacagatccagactcttctagttgtaggtgtcagagccttaacttgaattaacaaaagccaaaaggccagtgcctgtggtcctagctactagggaggctgaggctacagtgagctgtgatcataccactgcacaacttgggtgacagagtgaaaccctgtcttta

SEQ ID NO: 13882 - DNA, 439 bp, Homo sapiens
tgtggtttgggcgcctcatgtagtgcctgcatccaacccgattagtcaggatagggatctgagaaatgcccatacagtttgtgagacccagaatagtgacacgtgagggcaaagtggacgtgatactccctcataaaatctaggttccaacctgagaggatcagggttgtttgaacctcagttatgatgattctatactggagttccccagaatgctagtgagaagcaaaacaaaatcttgtctggaggaagttacaactgaaattgtatttttttctttctttctttttttttttttttttttaataactccaaacacctttttcaaataaagtgacccacacacatgaacccgggaggcggaggttgcagtgagccgagatcgcgccattgtactcccgcccgggcaacaagagtgaaactctatctcaaaaaagaa

SEQ ID NO: 13883 - DNA, 390 bp, Homo sapiens
ctaagtttaactcttaaaaccaagttttgttaaatctcacactgacaatgctgataacaagcttatcttcccaggtacagaataaggatgagacaaaatcaaccactcttctgcctaccctgaaacagatgaataactgagtctttactcccttttttcagtttatcttatatgaaacatagatttactgagcgttaatcagagcctcacaagaatgtaatcatttgcctcactgcctaacccctctcccttttccctcctcactctctcccctaaataatgagtttccaaaaccctctttagaaagctcaggtcacagatgctcatgtggcttgcgttttttctctggcatgtctttaaactttggcccaataaacctctactgattta

SEQ ID NO: 13884 - DNA, 460 bp, Homo sapiens
aaatgtacagttaagtgggttttagtatattcacaaggttgtgagaccatcaagactatctaattccaaaacatttcatcaccccaaaaggaaacttctacccattaacccatttatgccagaagttgtaaaaattttttgtgaaaaatcagaccttggcaatcaccttgagcagtaagatatcaataactcccacaagtttagcattccaattttggaacagtaggtaggcataaatgggttaacagtcatcccccatttctccctccccactggcaaccattagtctgctttctctatatctagatttaggcattttatataaatgggatcatgtaacatgtggccttttgtgtctggcttcttttacttggcataacattttcaaggttcctccatgttgtagcatgtatccatactggattcctttttattgccaaataatattccattgaatgga

SEQ ID NO: 13885 - DNA, 390 bp, Homo sapiens
taaaatgtgaaaacagcaatctgagatggagagaccaatgataagtggaattgtaaggaaactgagtatatagcacagttaaaatctgataggaagcagtaaaacatagaattaatactgtaggaaatggaaccattgacataaaggatgatattggaagttctcacaaaatactgagaaaaaaggaaaaaagatttataaaatggtgagaaactgacaaacatgaaggataaagaatagaaatctggcctaagaaattgatgatcttgaggccgggtgcagtggcttacacctgtgatcccagcattttggaggtcaaggcagggggattgcttaagcccaggagtttgaaaccagcctggacaacacggtgagaccctgtctctaaat

SEQ ID NO: 13886 - DNA, 1644 bp, Homo sapiens
agatatgacaggtaggctctttcaggctacagggagaagacactttagagaaaatgttagggagtaatagagtggctttttcgtttttttgcttctctgcttatagtattttgttttgggagggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13887 - DNA, 2481 bp, Homo sapiens
cccgtcagttcgcgggcctctcaacacccaccgcggcgccacgccgacttatataccagcgagtgtgggcggggacgggggttcggtccgcgctgggcccccccagcttctgccaatgaggaagaagcgagtctacgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaaccaagccaagagggcttgggggtgatgcaggcacagcagatggccgaggcaggacactgcagaggaagataatgaagagatctctaggcaggaaatccacagctcctcctgcacccagaatgggaaggaaagaaggccaagggaattcagattctgaccagccaggcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13888 - DNA, 493 bp, Homo sapiens
  misc_feature (19)..(19): n is a, c, g, or t
  misc_feature (28)..(28): n is a, c, g, or t
  misc_feature (59)..(60): n is a, c, g, or t
cccccttaaaaaaaaaaantttttaaangcttcccccaaagagccaaagggccctttgnnaagccaagctttttttaaagaagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13889 - DNA, 362 bp, Homo sapiens
gttttcccgggacgttcgggtggaagatggcggatttacctcagctgcggaaacgcgacgctgtttccagttgcgcatgcgcctcggccccgcgagcgcaccgccctcgggtggagctagtgctcagggcgtcctcgtgccttttcttggtggcgggaaacctgggttgaggtgtgaggggcttgcggagtcgctgcggcagctggttccgcccatcgcctttaggtcctccttgctcctgaaggtagccagctagtttctggttgtaggtgaaggtgctaggcgctgccagtcctggcacccgttgcctgaggagaaactttctcagggcgacaaccagcccttcgccctttttcctcaga

SEQ ID NO: 13890 - DNA, 2434 bp, Homo sapiens
gttttcccgggacgttcgggtggaagatggcggatttacctcagctgcggaaacgcgacgctgtttccagttgcgcatgcgcctcggccccgcgagcgcaccgccctcgggtggagctagtgctcagggcgtcctcgtgccttttcttggtggcgggaaacctgggttgaggtgtgaggggcttgcggagtcgctgcggcagctggttccgcccatcgcctttaggtcctccttgctcctgaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttgggtatggcatgtagtaagagaaaaagggtttcagttaagcagtgactgttacctgagagggagagttaagtctgacagcttctctctttctctcccatcttctaaataagggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaaccaagccaagaggcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13891 - DNA, 2263 bp, Homo sapiens
gttttcccgggacgttcgggtggaagatggcggatttacctcagctgcggaaacgcgacgctgtttccagttgcgcatgcgcctcggccccgcgagcgcaccgccctcgggtggagctagtgctcagggcgtcctcgtgccttttcttggtggcgggaaacctgggttgaggtgtgaggggcttgcggagtcgctgcggcagctggttccgcccatcgcctttaggtcctccttgctcctgaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatggagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13892 - DNA, 1480 bp, Homo sapiens
gttttcccgggacgttcgggtggaagatggcggatttacctcagctgcggaaacgcgacgctgtttccagttgcgcatgcgcctcggccccgcgagcgcaccgccctcgggtggagctagtgctcagggcgtcctcgtgccttttcttggtggcgggaaacctgggttgaggtgtgaggggcttgcggagtcgctgcggcagctggttccgcccatcgcctttaggtcctccttgctcctgaagctttcagtatttgttattgtgaaagaagttaattcacctgaaacagaggaggggcaacctgagttatcagaaagtgacttcctggccttcccttctttactgatcaggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13893 - DNA, 1738 bp, Homo sapiens
tactttttagtagagacggggttcaccatatcagccaggttggtctcgaactcctgaccttgtgatccacccgccttggcctcccaaagtgctgggattacaggcgtgagccaccaggcccagcccatttatcatatttctatagatttctctcagctcaggaaagatacctgtttgagttgggaaaaataggcaagtagatggatgaaatggcctcaggaggtcttagagagcttaggattcatctgtcttccttttactcgggttttttcagaagaagagttctgcaattgctctatttttacctttcattaaaataaaacctcattttcagagaggaggtaccacatactcaagagatttcagtgtcttgggaaggtgaagctgcccctgagataaggacatctaagttaggccagccagatcctgcaccctctaagaagaaatccaatagactcaccttaagcaaaagaaagaaggaagctcaagatgagaaggtggagaaaactcaaggtggacatgagcacagacaggaagaccgactaaagaaaacagttcaggatcattctcagatcagggaccagcaaaaaggagagataagtggttttggtcaatgtctggtctgggtccagtgttccttcccaaactgtgggaaatggaggcggctgtgtgggaacattgacccctcagttctcccagataattggtcctgtgatcagaacacagatgtgcagtataatcgctgtgatattcctgaggagacctggacagggcttgagagtgatgtggcctatgcctcctacatcccaggatccatcatctgggccaagcaatacggttacccctggtggccaggcatgatagaatctgatcctgacttaggggaatattttctttttacttcccatcttgattccctgccgtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13894 - DNA, 1384 bp, Homo sapiens
cccgtcagttcgcgggcctctcaacacccaccgcggcgccacgccgacttatataccagcgagtgtgggcggggacgggggttcggtccgcgctgggcccccccagcttctgccaatgaggaagaagcgagtctacgccgttttcccggggagatgcgccgcccggtctccctgccagcggagtgctgggccgaggacagggcggcaggggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagtctaagtaccatgtgacgttttttggagaaacagtttctcgtgcatggatcccagtcaacatgctaaagaacttccaggagctgtccctggagctatcagtcatgaaaaagcgcagaaatgactgcagccagaaactgggggtggccctgatgatggctcaagaggcagaacagatcagcattcaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaaccaagccaagagggcttgggggtgatgcaggcacagcagatggccgaggcaggacactgcagaggaagataatgaagagatctctaggcaggaaatccacagctcctcctgcacccagaatgggaaggaaagaaggccaagggaattcagattctgaccagccaggcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13895 - DNA, 864 bp, Homo sapiens
ttgtttcttggttcccttaggaacgggttaacttgtttggtttctggagccgattcaacggatctaacagtaatggggaaagaaaagacttacagctctctggtttgaacagcccaggatcctgcttagagaaaaaggagaaagaggaagagttggaaaaggaggaaggagagaaaacagacccaattttgcccattcgtaagcgagtcaaaatacagacccaaaaaaaccaagccaagagggcttgggggtgatgcaggcacagcagatggccgaggcaggacactgcagaggaagataatgaagagatctctaggcaggaaatccacagctcctcctgcacccagaatgggaaggaaagaaggccaagggaattcagattctgaccagccaggcccttaagaaaaaatttaaagctccccagagcaaggccttggcagccagcttttcagagggaaaagaagttagaacagtgccaaagaacctgggcctatcagcgtgtaagggggcctgcccctcatctgcgaaagaagagcccagacaccgggaacccctgacccaggaggctggaagtgtcccccttgaggacgaagcctccagtgacctggacctggagcaactcatggaagatgttgggagagagctggggcagagcggggagctgcagcacagcaacagtgatggcgaggacttccccgtggcgctgtttgggaagtagctggtgctcctctgctccctctttttctcccttctctggggcgcaggagggagaagttgctaagtgctgggtctgttcattggctatgaggttcaaatgtgtgtggtgcagtttctgtgttaataaagcaggttacagtcgaaaaa

SEQ ID NO: 13896 - DNA, 1044 bp, Homo sapiens
gttttcccgggacgttcgggtggaagatggcggatttacctcagctgcggaaacgcgacgctgtttccagttgcgcatgcgcctcggccccgcgagcgcaccgccctcgggtggagctagtgctcagggcgtcctcgtgccttttcttggtggcgggaaacctgggttgaggtgtgaggggcttgcggagtcgctgcggcagctggttccgcccatcgcctttaggtcctccttgctcctgaagctttcagtatttgttattgtgaaagaagttaattcacctgaaacagaggaggggcaacctgagttatcagaaagtgacttcctggccttcccttctttactgatcagaggcacacaaagcgtagtttctaagctgaatgatgacaacgttgcagaataaagaagaatgtggaaagggaccaaagagaatctttgccccacctgcacaaaaatcttacagcctgttaccttgtagccctaactcccctaaggaggagaccccggggatcagttccccagagacagaggccaggataagcctgccaaaggccagtttaaagaagaaagaggaaaaagcaaccatgaagaatgttccaagcagggaacaggagaaaaaaagaaaggcacaaatcaacaagcaagcagagaagaaagaaaaggaaaaatcaagtcttaccaatgcagaatttgaggagattgtccagattgttctgcagaagtcccttcaggagtgcttggggatgggatctggccttgattttgcagagacttcttgtgcccagcccgtagtatctacccaatcagacaaggagccaggaattactgcttctgctactgatactgataatgctaatgggtaagtttatttcagtgaggcaagttgaacacagaatggactacacattcatggtcagtcagtctatctatctgtctgtctatctggtcatttatcatatttctttttttttttttttttgagacggagtctcgctctgtcgcccaggctggagtacagtggcgtgatcttagctcactgcaacc

SEQ ID NO: 13897 - DNA, 5233 bp, Homo sapiens
cggccgcccgggcaggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgcccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtagatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgctacttttgtatt

SEQ ID NO: 13898 - DNA, 5239 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgcccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtagatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgctacttttgtatt

SEQ ID NO: 13899 - DNA, 1535 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctgg

SEQ ID NO: 13900 - DNA, 359 bp, Homo sapiens
tgagccataattggaatatttagcgtttattgtaggatatttggattgtttttcaaaacacaaaatgctctagggtttataaaagagggatgatactactagtgatcttgtagtgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttttgtcctcattcaagatgtgaccattcccaccagttgttgatttttcaattctgcaaa

SEQ ID NO: 13901 - DNA, 5534 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgcccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtagatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgctacttttgtatt

SEQ ID NO: 13902 - DNA, 3016 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgcccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagagaattccaccacactggcggcccgcgcttgat

SEQ ID NO: 13903 - DNA, 4518 bp, Homo sapiens
tgagccataattggaatatttagcgtttattgtaggatatttggattgtttttcaaaacacaaaatgctctagggtttataaaagagggatgatactactagtgatcttgtagtgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccagggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccataccgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgcccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtagatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgctacttttgtatt

SEQ ID NO: 13904 - DNA, 464 bp, Homo sapiens
atgtactacctaaaagaggtagaagtataaccaagaagtcattcagtgatatgtttactttttaaaagtttccagacataacactgcacaactgcagctttcctccgcaaagtcatcaaagagctaaaatgtacaaatgggaatagggatataaagtggaactgaagataaatggagagccacagcagcccccgcaatacttccctggtgttggttcctcctgggaccataatctgggctgacatcttctctccttccagcatctctttcaaataacatgaagatctggtaaatggccagtcacagcctctggctgctcattctggtaggtctgaggtcagtttggctataatatatctttcttattttgtccctctattgtggttttgtatagattttcttgcctgtactacttcttaactaaaggatagttaccatggcaacacctgttgatgacagacaaa

SEQ ID NO: 13905 - DNA, 548 bp, Homo sapiens
caccacgcctggctaattttgtatttttagtagagacagggtttctccatgttagtcaggctggtctcgaactcccgacctcaggtgatccacctgccttggcctcccaaagtgctgggattacaggcatgagccagcatgcctggccaaaaaataaagatttttaaaagtggatttaaaatctcttatcacctagctcagtatatggccttccttagtcagtactcaataaatatttactaaatgaaaaaatcaatcattaataataaaagtggttgggcatggtggtatatgcctataatcccagcactttgagcacaggagttcaagagcctgagcaaggaggagttcaagggcctgagcagcatagcgagacgcacctgtggtcccagctcctggggagtgcttaggtgggagatggcttgagcctgagaggtcgaggccgcactgagccgtgactgcaccattgcactccagccttgaggctgcactgagctgtggctgcaccactgcactccagcctgggtggcagagcgagaccctgtctc

SEQ ID NO: 13906 - DNA, 760 bp, Homo sapiens
tgaatttcagagtagttagaatgtttttcttaagactttgctagaaaggaactggtttgttagtaattctgccatcaactcatggagttataattgccaaatgagttaatttttatataccttaagctatcttgcctacaaaaagtaaaataaggcaggattcataaatgttacttgtaaattgagtgtttcacatgaggccaagtatgattttaacataatgaatatcattgctcctcatctgtaaatttgctgctgctttcatatgtgtatctgtacatagagttatgaatgaaaatccagtaatgccctaaagcaactttcttccatagggtcaaagctcacttaaggtaaacgtgtgaaaaaagtgactgcagtgtgtttgaaaccacaagctgtttctatgtcataaattaacatcagcttgcaagtctctgaaagaaccactcatttgtaattggtatatatgtcacaacctcccacattcctttagcccatctcagggaattattgaaacgctggcagggttagtttcattttgttttggtttttttgggtttttttgtttgtttgaggattttttttttcttttatcatttgtttgctcctgtgtaagcttaatatataatggcagtttggcatctgttcttcgcacatgtctaacccagcagagttatgcaaaaatgatgacttcattttaggtcaaattggctttgttcccagtcctcattgttggtcactttgttcagttctggtgact

SEQ ID NO: 13907 - DNA, 563 bp, Homo sapiens
tgtgcgcctgtgcttcattttcctcctagtgattccagtgattaaagtaacttttctaaggtttttcagggaactctacatgaaaaaggaacccctaatcttaggaggaggatcctcccgaggaatccaagtcctccccagctgtcaggggcacgacttactttaaataacagatgctttgggaaaattgtccaaaacaatttttgtgactgacgtaatatctcaaagcctgccagggaagattgctattaaaagaaagtccattgtgggccaggcgccgtggctcatgcctggaatcccagtactttgggaggctgaggtgggcagatcgcttgagcccaggagtttgagaccagcctggcaacgtagtgagaaccccatctcaaaaaaaaaaaaaaaaaattagccgagcgtggtggtgcatacctgtagtcccagttacttggaaggctgaggtgggaggatcccttgagcccaggaggtggaggttgcagtgagctgagatcacgccagcgcactctagcctgggcaatggagtgagaccctgtctcaaaaaaaaaaaa

SEQ ID NO: 13908 - DNA, 1171 bp, Homo sapiens
cccagacaacccctgcaaagtgactctgagaaggacgacaagccctgctgcagtcacacccagaagctgactcatctatgcacagccaaagcatgaggaaactcatcgtgggacttattctccttaaaatttggacttatgtaataaggacttccactgattttccccacatggaggactgttcccaatgtattcatcaggtcactgagtagggcaacaagttaaaacagtttctgttttatagttattattgttgcgggacaatcaaagatgggagagaccaaacaaagtgagttcaggaaaggtctttattaaaagatgatcacttggctcagtaggattagtgtacaggaaagtctgagccctggacaaagaaagcagccaccttttaagcagtcagtggctgggagctacgtgatgcaggaagcacacttagagaagcaagaacaaaggcagttgatcagtcttttacatttatctatactacatgttccaaatccttgggaaaccatgtttctgtataaaccttgtaactttgcagctgcacgggggaggtgaagcagaaactcgctgagcctcaaggaatgtgaaactagcaagtacagataaggctcaaatgtattacatgaatcattatcaatctgtcttgcaggaagacctaggtagtgaagatgaaagtgagaactcccactaataagtgagattctcaaaggggggaatgaggaaggagaccacctctcttattgtttcatacctcagaaaaagaaggaagaaataagttaaagaaggcaaaaatgagataaatagtcaggcagcctggccccgcaccccaggcctggtctgctaattaaatatcaacccctgactaactgcttgtactatctatagattccagacattgtatgaggaagcattgtgaaactttctgttctgttctgtcttaactaccaatgcatggggccccagccatgtaccccatgcttgctcaattgatcacaaccctttcacgtggacccccttagaactgtaagcccttaaaaggggcaggaatttccctcttggggagctcagtttttgagatgcaggtctgctgacgttcctggccaaataaagctacctcttccctcaacccagtgtctgaggggttttggccatggcttatcctgctaca

SEQ ID NO: 13909 - DNA, 806 bp, Homo sapiens
cccacaaagtttttatatgtcagaactggaggtggcacataccacttctgttcaaatgccattatgtagaactcagtcacttggctacacttaagtgtaagtttaggaggctaggaaatgtagtctgtgggcccaggatgaagagaataagagtttggtgctagctttctgcaataaacttttgggctgtctgctaggtgctggaaacaaaattataaaagagatattccagctaagtgcaaataaattgcaacatagtgaaaaaaatgcctcactacagatatagcaaatgtcatttcacagagtaagtcaaatgacacatgatcacagttttgcctcaaacaaaatcccatggtataacttgggacactgaactgaagctcttagtttcttgaatccctatcaccatatgtgcacatacaggctaataggttataaatattctgtgttccatttcagataaccacagtaaagtgaatactgcaataaagcaagtcaccagaattttttaatttcccagtgcatataaaagttatgtttacactatactgtagcttattaagtgtgcaatagtattatgttttttaaaagccaatgtacataccttaatttaaaaattctttattgtgaaaagatgctaacgatcatctgagccttcagcgagtcgtaatctttttgctggtagagggtcctgccttgatgttgatggctgctgactgctcaaggtggtggctactaaaggttggagtgactgtggcaatttcttaaaataaaacagcaatgcaattttccacaaacgttgactg

SEQ ID NO: 13910 - DNA, 431 bp, Homo sapiens
atctacgtgtaaacaagcacccaggggagttctgctcactgaaatttgagaatccctgatttagaaggaggactatgctctgtgcatgttctctgaaatgttgggtcaatcaggacctgtctactgaaactgctccaaccagccaaggtgcagagaaaagatgcgtgcagggccgaaaaccagggtgctctggaggcagggagccctcgagaatgtaaagccagcaagctgttacagagtgatttgcacagaacagacactcagttgatatttgtcaatttgctgtgtttaagaaccttgctgaattaatttaaaaggtatttttaaaagaatgaaattgaggaaaaaaccttcaaggttcagaaaatgtgaagttctcatttacttgtttatgaaattgtttttgagtccaataaagatgctcagctaaa

SEQ ID NO: 13911 - DNA, 576 bp, Homo sapiens
gggagggagggataaaagactacaaatagggttcagtgtatattgctcgggtgatgggtgcacccaaatctcacaaatcaccacaaaagaacttactcatgtgagcaaataccacctgtaccccaataacctatggggaaaaaagagaagaatatacaaaaaatttaaaaactgggccgagcgcagtggctcacgcctataatcccagcactttgggaggctgagtaagcccaaagtcactgaggtctgtctcacgccattctcttcagcaagtcactccatggcctgcatcctccacaaccaggagtctccagcctcctcccccagggcagattttgtctgaatctcaaagagttggaaagggagagggcagccacacagagttcccgctgacaaccaccactctagactgggttagtggatcaggttgactggtgttgggggccaggggtacatggaatcctatggccatctggatgtcagcaagtgcagggcacagtggctcacacctgtaatcccagccaaaggaggaggatcacttgagacaaggagttcaagaccagtctgggcaacaga

SEQ ID NO: 13912 - DNA, 441 bp, Homo sapiens
ctaagtattaggaatggaattattaggtcaaaagataacttcattttttgtgtttatagctatagctgggttgcaagctttctattatttgcttgctatatcttcattttaattctttgtgttttatgttagtgtttcttatgtctgtttttgttatctgagtggttttatcttttaataggctaatttaacccattcatatttgtaattattgtattatttagacataatttggaagccctattttatttgtagttatactattgtttagggtttttttctattaagctttttgttggattgactgtataatttttttcttctagtattctttgaaaatttgaaaattgttatattttatgtctagtgttctttgaaaataattctttgaaaattatttttatgtcctaattttaccattaaaattatgaccacttgaaa

SEQ ID NO: 13913 - DNA, 704 bp, Homo sapiens
ggaaacacaaatgttgttgacagttaataaccgtactcactcagaacctggtgcaagtgtgttgagaatgccctcccactatgagtaaaggcctgcccgcattgcatgggctcagggctaggaaaggctgctttcctgtgctatgtcacagataagtgacacactcagctggatgaggggaccccaagagaaggaggaatcaagtcaccctccttggctccattcttgggaaagttttgcaacaagaatattccgtcttcactgtcgtgggagttgaaggtggagaagggaagtcagtccttcaccttgagggagaaggggccacctgctgaggctgtgggccatggtgtcagagatgcctgggttagggccccacatccatctcttcagcctttcaagcctcgctttcctcatctgtaagttggggataaagataataatccctgcgtcctgaaggccactgaattgaatgaaagcttcatgtggggctcttagctgagagcttggcatgcactaagtgctaaataaacggtagctgctattgtccttgtcatcatcatcatcaccatcatcatcgtcatcgtctatacctatcctatgaccctttcagaaatctctgttctccttcgctattcatgggaattctgttttcttgatgccctcatgctcaagaatctcctcatagttcctcatccagggctaaa

SEQ ID NO: 13914 - DNA, 159 bp, Homo sapiens
cttttggtttgaattaataccagttattaatttcagaaaacataatcttagtatgacttctaaaatcagtctacttaaaatgaacatgcttttttgttataaatgtttcatgcaatgactgtttgtctccagagtaaataaatatccattaacacctta

SEQ ID NO: 13915 - DNA, 254 bp, Homo sapiens
ctccgaaatttctcaagaaatttatgtatatttaatatacatacttaaaaacttgtatgagttatctgttgcttcataacaaattactccgaaatttagcagctttaacagccagcttagaacagatgagtcaggaatctgagcacagcttagctgggtgctctggctcagggtgtctgactaggctgtcaaggtgttggacagggctgcagtcatctcagggtttgaatgaggtaaaatctagttctaaactc

SEQ ID NO: 13916 - DNA, 564 bp, Homo sapiens
tgttgggaccaggaataaggcaaggaaagagataactgattattataagacaatccacggcaagccaggtcatcctttctgactaaccacaactcttgtctccttacaccagtatttttcaacctcagcaatagagatttttgggccagatgattctttgtgtggagagctgccctttgcactgtaggatgtttagcagcatccctggctctattcactagataccagtagcaccctctcccagtggtgacaaccaaaaatgtctccagacattgccaaatgtccagtggttggggaggagaagagcatgtcaaaaatcactgcttgaagcccctgtttaagagccactgcctgacgaataacattattaaggccactcaggaaagtttgcttcccctttgccatggttgctgctgcttctcagtctaaagctgactagcacatagtccctcctctttttgtatcaggcatccaaatgcccgctgtctcatggaagaacatatttttgagacagagcctcgctgtcgccaggctggagcaaaactccgcctcaaaaaaaaaaaa

SEQ ID NO: 13917 - DNA, 489 bp, Homo sapiens
acttcctgtccccacatgtttacaaaggagcttgtccactccacgcctggcaaaaaatgtcacagttctaagcttatacactattggtgggaatataaattagttcatctattgaaaatagtatggtgatttctcaaaggactaaacacaagtaccattggacccagcaatccatatagagctaccaatccaaacggaactaccattcgacccaggatctactcaaaggaaaccattgtattaaaaagacaactgcactcctatgactatcactgtactattcacaatagcaaagtatggaatcaacctaagtgttcatcaacggatgactggataaaggaaatgtggtgtatctatacgatggaatactacagagccatcaaaaagaaaggaaacatgtcttttgcaacaacatggatggaactggaggccattaccttacgcgataactcagaaataaaatcaaatgcacatgttctcacttttaag

SEQ ID NO: 13918 - DNA, 459 bp, Homo sapiens
taaagcagtgatagtatcagctctttaaataatactatgcttgatgaagtggtacttttcgggataatttgagaccagccgacttgctgcttgaagaggacagggctatatttggtaataatatatatgtgataatatgtatgtaatattattataatgtaatatacaataatatttggtgtaactggtgactctgaggccagtctttgatcgaacctctcaagctatgatttacattatggtcaatgttagcataatgcaattatcagcaatcacttgctgttgctttgaaagtcagaaggatggctaataaaaatcttagaaaaagaaaacaggccgggtgcagtggctcacccctgtaatcccagcactttgggaggctgaggcgggcagatcatgaggtcaggagattgagaccatcctggccaacatggtgaaaccccatctgtactagaatac

SEQ ID NO: 13919 - DNA, 152 bp, Homo sapiens
tgtaaaggatgttatcttttatagtgaaaaattccttctacagcatatcctaatattaatagatctcatgaaaagcctatgagctggagtcacctgacacccagttcaatgctgtttctgtatttcatggtacaacatcatatagctcaaga

SEQ ID NO: 13920 - DNA, 469 bp, Homo sapiens
tccttatgtctcaaatacttcatatttaaaatattttaaggactttatacagtatacataacccagatcttcagtgaatggtaggtagtatggaataggatgactgaggcttaaaaatgctaaattacttccccaccagaaagaactgctggcagtgccaggacttgaactcgtgcatatatatggatttacagcaatctatactttgcaatacacaggaggatgaagcatttctccagttctgtttttaaatttggcctagttactggtggaggtgaccagctgcttcacaatttaattctagtccaacagattttagtgccacgcacttgtgggtggacatagtagttcttcctcatgccttgctcacttctaccaagtattccttctagtcttcttttctaccagttccttccattttcctccctcggttcaggcagcagctagttcaatgtctattttaggcttg

SEQ ID NO: 13921 - DNA, 413 bp, Homo sapiens
caaaaaaaaaaaaaaaaaaagttttacacatcagtttttataaaagggaagagcatgttaatgtcttagataactgtatattcttccttaatactgtaccaaaacaagtagaagtttcttaaagattagttgcaatgtagaatataaaaccatatcgaataatttctcgtagcctgttacattgttacattaaaatccattgatctgtcttaaactttgggtctttcctcccatgcatcattttataacatcatacatcgatcatttggaaaatactggttcactgagtttttcaggttttccaaatcttgacacatttcattgtatattttaaaaagtcacatttgttgacattgccaccagtctcatcagaaaagcctctgtgtattgggaagtggttatgttcaccatgg

SEQ ID NO: 13922 - DNA, 435 bp, Homo sapiens
gtagaataggtcagagaagactttgcctttttatttagaggttctgtgtaattcataaagttttcaaacagaaagaagaggcatctgactaaaaccataaaaaagttgctaataatagctagtgcagtgcttcctatgtgctaggtaggcactgtgcaaaatgccttagataaattatctcacttaattctaagactgcaaggtgggccctgttactctatcttataaagaaggaaagttgccccaaagccacacagctcataggtgatggaatcaaagtttgaactctaccaatctgatactggtggagtatcagtctatcagtcttcttaaccactatggctgtctatttaggactgtttcacattcagaattccctagcaaaccttatcagataacataggaagaggtaagagctgaggtgttaaagaagta

SEQ ID NO: 13923 - DNA, 412 bp, Homo sapiens
gctgtatactgtatgattccatttctataacattctggaaaaggtaaaacaatagggatggaaaacagatcagtggtttccaggggttaacagagtggggaggtttgagggtgaacccttcgaaaggatagcatgaaggaatttgggaaggtaatggaactgctgccgtgcctacacaactctgtgcatttggcaaaactcagaactgtataccccgaagagcaaactttactgtatgtaaactaaaaaataaaataaacctgtattacactagtacaggtttaaacaggtcaatggaacatcacagagagctacaaatgaaatccaatatagttaatttgttttgctaaagatggcatttttaaatccatggagaaaatacacagtgctgggaaaactggttcttatcatt

SEQ ID NO: 13924 - DNA, 768 bp, Homo sapiens
ttcagggtcaccctctcccagaagtgagatcatggagaaaaagggcaaatcacagaaagaaattaaatccatgaggacccagcaggcccagcaagaacctgaactcacgccggagacctgcaggagtggtgccaggtcacccactaaccaaacaactgaagcgagagctggtggtcttgcttggtctcacagtgggcacagcggtaggcggtcagtcatgttgctgaacgacggagggtaaactccccagccccaaggaaacctgtgttggaagtaacaacaacctccctgctcctggcaccagccgttttggtcatggtgggccagctgcaaagcgtcttccattctctgggcagtggtggccccgaggctgtggcctctcagggggtttctgtggacacgggcagcagagtgtgtccaggccagcccccaagaatgccctgctcctgacagcttggccaacccctggtcagggcagagggagttgggtgggtcaggctctgggctcacctccatctccagagcatcccctgcctgcagttgtggcaagaacgcccagctcagaatgaacacaccccaccaagagcctccttgttcataaccacaggttaccctacaaaccactgtccccacacaaccctggggatgttttaaaacacacacctctaacgcatatcttacagtcactgttgtcttgcctgagggttgaattttttttaatgaaagtgcaatgaaaatcactggattaaatctacggacacagagctg

SEQ ID NO: 13925 - DNA, 380 bp, Homo sapiens
gcatagtgaaatttgcattttattttatagcaaatgttattattactccacctgccctctcttagatggaacaccaaaactaagagcgaaaatagaaacaatttaagaagagaacaaatattggaaacacttcagttaggcatcctcgcttgacaatactgaatttggcagccaggatagggcatgccaaaccttgatgctttctacctttcgtgtatgagtgtaccagctttccatttcaatcatctctctctctgtttctctgtctctccgcctctctctctctctctctgagtgtgtgtgtgtgtgcacgcgcacgtccaagtacttgtgtctactgttgcagttcaataaaggtaatttccacaagtgacactaag

SEQ ID NO: 13926 - DNA, 151 bp, Homo sapiens
tatcaggcccaggttcagaaatgtggtctttcttgctgtttttaatttgaataactacgtacaaattaatataactctggagtcttactccacggacgttttgacaggaaggtatacctcttactctaatgcaatggatatacatctatct

SEQ ID NO: 13927 - DNA, 2126 bp, Homo sapiens
atctaaagaaaaaaaagaagaaaagggaaagctcaggtgtttcagggtcccagaatgtatgttgtagagaacagtcattagctcaggcccatggtaaccgcctctactgtgcactcgaccagtagaggcgatgatgacggcacttgattctcttgtgtgtaactcagccatcctccctagacccacgtcccaggaggcagggctggtaaagctatgactgggcagtgtttgacccagctgtgcttttactctgtgcctcctctttatattgtggcatttctctcttctcctttatgttctttttctttttatgccaaaattcttgctgttgccaaaacaaaaacagaaaaacacacccacacccaattacaacctgcagttcaaagaaccactctaggtcggctttaaagtattgtctttctctggtaaccaaatctgtacctgctgcctaatttagtgtttgggggcattgtttacagtatttctgtttgtaatgtgcttttaatatagaaatcctcttttttgttcttaaatctatgaatgctgtgtttccaagcttatacttactactgcgtgttagtggttctggcacagattttcttaccctggccttgtactgtccaccatgactttagaaaaagcttgaacaataggcagagaaaggaaatccccaaaagggattattttccccttggacatgagaagtttagttacaggtttcttgaattcgtttttgtccagaggaatcctctttttatctgatacggttgatgaccaaaaatgaagtagggaagccgaaggcatagccggaaaggaacagaagagctttttccccgagtgctcatcaccgggttcattaccggccagagatggacggggagaagcacgttagtttcctgtcatcttatggaaaagatgatctgaagttaaaaaatgaaggtcacaagtggcagttgcctgacccctgtccccagacattccttgcccgataaccatgaggttccatagttcggatcctgaatgggcctttaggaaatgcaggcctttcccacaccagctagaagggtagccaggcagtagaatttcattcaaccctagggttcccacctgacagagggaagttcggaagtcttactgcttcccacgtccccttcccttctaggcatttatggaaagctttttagtggagcaagagaattctacaatccagcttacctcccaccttaccccaagagccatagctgacggtgatgtgtgaatgtttatatataggtacacgtttgtatgtatatagatctaattgcacatatatgggtagatatttatttatatgttgcaccctaaattatagtaattataataattgtgaagctgtttctaaagctgcttgttcctggttctgagaaccacgggagcctcacactggggagccgtactccaggtcagggctttggggatgcacagcagcgtacgggcagcacgcctgtaaggaggtgagtgggtgggtgtctcagaaaatggggcagcacacccccaagaaagggccccaagagcagactagggaacgcagggggctgctgctgccaggacaccacggagagccgggcacccgcctcacatgtctcctgtctggctccactgagttagccgtttgagcccactcctatcttttggtggttagtgcatcttcagctcttttctgcaagacactggaacattcctaggctgtcccaaaaggagttccaccatagcctttaaggtccgagcagggcaccaaggggttcacttttctcccgagccattcagcttggggtgcctgcgggaggggcggacagccagccggcttcccggcggcggtacgagagcccaacaggagaggattagctgtgccaaggaacacgccactgctgcctgtctactgcccgccttctctccacttccatttttgcctttgtttttaacttgtgctcttgtgagttcttggtgtgtttctttgtgagtttttatttaattgtgtaactttgtttttgccgttgactgtgaaaccaagttgtcgtgcttttaattttttttttaacaaatgttacattcttatttaagagaataaattccaaacaatcttcgga

SEQ ID NO: 13928 - DNA, 446 bp, Homo sapiens
gaaacggttaacatcaaacagcaaacaactaatcaaaatcctcagaaggcatttatctcccaaagttcctcttcagctgccaatttgccagtttcttcctttcttgttcccatcctcattcaactttcttcccgtttcttatcaagatcaatctaggctgggcatggtggctcatgcctgtaatcccagcactttgggaggccaaggcaggaggattgcttgagctcaggagttcaagaccagcctggccaacatggtgaaaccccgtctctactaaaaatacaaaaattagctgggcgtggtggcacacgcctgtaatcccagctactcaggaggctgaggcacaagaaccgctttaacccgggaggcagaggttgccatgagccaagatcatgccactatactccaacctgggcgacagagtgagactctgtcaaaaaaaaaaa

SEQ ID NO: 13929 - DNA, 565 bp, Homo sapiens
tttaatgctcacaactaccctgagagttgctattgttaccctcattagctagctaggaactggaagagtgggattgaaacccagagctgtgggattcaaaggcccacgctcttaaccacatcatgatattgccttgaaaacagaaataatatctgtaaactgaccagcacaatgccacatagaaagaaaatgttcattgtaaagttatggtttggggtttgtttattgctattgctgttattgatgttatcttgacctgcccaagggcaagagttcaaactctccaccgtaacaattagctttgtcttctgtttctgtggccttttacctgccactcttttcagcttctcagtcatcacccagtaaaagtaatctttttattctggttggtgaactaatctagcctttaatgtcaagtgtgaacttcagttcctcagtgctcattgttttctgctgaaaggttccctttcacacctgtgttagttactaccccagatgcttaagactagcaggatctctcagtagctgagctattaccataatagcctttcttatagtgaaggag

SEQ ID NO: 13930 - DNA, 662 bp, Homo sapiens
gtgctgtgtggacaaagaagagtgtttatttatttgccttttatgcatatacatatgcatatggtacatatggtgatgggagaaacttgtctaatttgaaactgttcacctcctactgtaagatggcatagaatctacgtccagtatcaaaagttattataattgaattgctcaaacttaaagggcaactgttaaaaggtttgcttccaagggaaatcagcctttaaaaggtaatttaaagtcaaaacaaaggtcagactggcagaggtacacatatccacttagggacagatggattgaatctgcacttgcattggtagccaattaggtaagtgaaaacttctgctttgagtattttagctttaaaaacttgatataacagaagtttgattatagtaactgaaattggaagtggaattacagtgctgtattataactggaaactggaaattggtatggctctttgttcctctctagagttttagtctccagtttggtggtgggtagctagtgaagtttgaatatactgtattaccaaaaaaccgttataggctgggtgtggtggctcatgcctataattctagctctttgggaggccaaggtgggagaatcacttgagcctaggagttcaagaccagcttaggcaacatattgagatccca

SEQ ID NO: 13931 - DNA, 327 bp, Homo sapiens
tcctatcttacaaccttgaaatacatagttaattctgcagggtctcagacatcctactgagttgccaaatattgaacaccaagctgggcttgtcaacactcagggctacaaagaggagatctcaaaactaccatggcctcaggattctgaatgtgggtctgaaatccctacttcttactttggattaaaagctcacctgagctacacacatctgttgtcctagaatggatatttttatttagatatcaaccaattcaacttcactcctttattgagtcagtcaagaaatcaataaaattgacttcaaaaattgaaatcacttcttaa

SEQ ID NO: 13932 - DNA, 336 bp, Homo sapiens
ccttatagattaatggctagactagtatctgctttctgttgctaagtttgtgagtccctatctatatcttctttaggagttgactttcccataggtaaaagtttgattgtttgaatacatttaacatgggctttggcgttagtgagaaacgaagtccaagcctgactcttttattagtatttaacctttaacatttctgagcctctatttcctgatatataaaaagtaaacaataaaacatacatatatgtttattatgtatgttggtagatattatctaaacatatgttattatatatgttgtttatgcaaaaagtaataaaacatgttttatat

SEQ ID NO: 13933 - DNA, 418 bp, Homo sapiens
ctctcacttcacaaaggcagcctcctctcccccgctcccatctggaaggctaccaggcagcactgccccaggggcactgaacaaggggacaatttaaaacattgacactggtgctgacacagtgcctagctctgaggtcaggatgagaaagactccacaagtcagacattttctgattctctgctttcaacaaaacacaaggaggtcctagtggaagtgtcatctgatagattgcggaaagtcatatctgacgacaaattatacttttggcattattatggaaagaattcaaataactgagtgacactgtaacaaaactatcattcccatctacttactcacgtaaacaaggtttctgggcacttacgtgtttaaaaaaaccatacaatttatttccaataaatgttaagcaaaaatg

SEQ ID NO: 13934 - DNA, 470 bp, Homo sapiens
gattcagggaccacactccgcttctttcactcattcgtttagtgtttcctttaagcctttgccttgttgttatgagaatacaaaaataaataagaccagtacttccctccaaagcactaattgtgagagcatgctgatggctttagcaggcagcatgcttgctgtgttgagataagagcagaatacagtcatgcaccaaataacatttcagtgttggactgcatatacgacagtattcccctaagactgtaatgaagctacaaaaatcctatcacctagtgatgtcttgcgatccttacccaaggaggtcttggcttacgtgtatgtgtatcttaatttttgagaaaaatgtttaaaaagtaaaaagttaaaaaaatgaaagcttacagaataagaatgtaaagaaagaaaacatttttgtacagttgtgcagtgttttaagctgttattacaaaagaatccaaaagtta

SEQ ID NO: 13935 - DNA, 472 bp, Homo sapiens
ttcttagcacagtagcagctacccatcccccatcccctatccttgtggcaggtgggtgtgcacatgttcctggagcagcttgcatgcaggttgtgggagccagggtggataaaaaaagactctgtcctccaaatagtggagatctgtgctttgattgctaattgctgcttctgattacagaggttcagaggtggacattgtggtttcacctccctccattgttgcaagctccccctaccctctggctgaagtgacttcctggttatttaaaaggctggtgcctttttgtttttcctgtgctcttcatttttctcttttcccccctttgggagccagacactgaagactatgacattcaaaagtaacctcatatacaagagaaattagaaagttacagtacatgtgcaggggaaggtgcaagctctgaaaacaccctaattttatacctcagactgatcctcagcacagggat

SEQ ID NO: 13936 - DNA, 406 bp, Homo sapiens
ggaggtcttctggatttttatagcttgcagataaagatccaacaacatctggattttctcagatgtgagaagctggtcatagattggtgtcatttagaagacaaaacatgagattgatgtgttttaaaagcacgcagcggatgctgcacacaagaaaggcgtggttaatgagcactccaggcctgcgtttcagcagggtgtgccaaagaatgatgcctcatgaggcctcctccatcatcctccatgtagcgcctgttgtgtgagctgatccaccgagctccccactaggtgaagcatgagttgtcggaggtctgggagaaaggagcagctgtctctgccgtggctgctgcagggacactgtgtaggctctgtgccctggtctgcatcagaggctggggcctggggc

SEQ ID NO: 13937 - DNA, 716 bp, Homo sapiens
ggtctattcttgtcaaatatgtcttaagtgtgtttacatatagtttgcctttctggtattttctgcttgcacagacctgatctccacctattttgtgtcaacagttgctgaggctggtgttgggtgattaaccgttaagcacggaagcgcagtacccagagagaccctctctctcctctcacttacatcatcatctggcttcaggctgtgcctacagaaaacaaacagcatttttgagtggttaaaaagtcagcctgaaatattaaaaaatggggcaaatgttgcctcctggttgaatagaacagttttcttgaaaaatggagtggagccaggggctcgggggaaggaagtgtttccgagggcaaacgttggtcttagatccggtctgcattgctccagtgtgtgcacgccgaggagctttctgtagacgctgagggttatgttctgcttcgtttttgattttcaaggggaaagaggacatacaaaacaaaaacaaaaaaaaacctacaacaacatggatgcctgtaactttggcaaatataaggctgtcctgttcaatgccctcataaatcattaatattttcctgtctattttattttcattcttacaacgctcttagcctgaccccttaatatggaaaataattaactctttcatgctcctgatgcctgaacaataacaaataaacaaaagaatattaatctgttccgacata

SEQ ID NO: 13938 - DNA, 422 bp, Homo sapiens
gtgccaagtactaggtgaagtttttacctctgttttcactgtgccagtcactgacttgtctaccagggtgaaattgttcatatttaaagaaggaataaactgagcaggtaggatgttaggagttggcagaggctagagtcccggtgttcttcattttatttcgaagtttgtactaatctctgctctcttttgtatttcagtcacattagcagtaataggaaggtgttttcagcgacagtggggatgttgtggcagagagggaaatatttgaagtccctaaatgtggaggtccagtttaaaacttgtcaagattaaaaaaactgtttagagtgagaccgggcgcggtggctcatgcctgtaatccgaacactttgggaggctgaggtgggaggatagcttgagcccaggagtttcacaccagc

SEQ ID NO: 13939 - DNA, 483 bp, Homo sapiens
gagatcaattcttccattagcaatgccacacataattcctaattctccaaattccagttccccatctagccaaacacacagtcactaacattacattgtggttccacttacaaatgactgcattttcaggtggaggtgttcccttaaaccattttctctggatggcgttccttcctccctcttcttcttcatccccattttcagtccgtaggatgagcttctttgtatgtaatctcccaaacgtctaccgctggagttctcagctttgacccccatcagactacacatgaggcagggtgcagattcttccactttcacctcctctccccttctctccctccgccgcctttttaaaaaatgttacttgtcccatttctacattgtgaaaacacgtagagttgcattccattcctcagccctgaaccacacctttgtttttgtcttggatctgcaattgaagatattaaaagctgtttgccattc

SEQ ID NO: 13940 - DNA, 737 bp, Homo sapiens
cttactataggcatagtttcatttttaaaatttgggataattaaagaacatacaatggtgtttaaaaaatcatttccacactctgagctgtagtaataataataataccgcaatgatactctctttattgcatgcctgctaggacaacagagttgggaggaggtgagaatctctgcttttctgatttatttatgcagataacctgcagtaggctaaatggcagcccccagagagatagtaagtatgtctgctttcaaactgaatcactggaaaaagactgattaaggatcttgagaggaggcatttgttctggattatccagatgggaactaaatgcaatccatgtatccttaaaagagagaagcagagaccaggacagagagaagaggaaggtaagaagacggaggcagagaccggagtgatgcggccacaagccaaggaacgccagagctactagaaggtggaagagacaagacacacatcttccctagtgtgcctggagggagggcagccctgctagatttacaacttctggccaccagaactttgaaatgaatctgctgtgttaagccctgtagtctgtgataatttgttatagcagtcccaggaagaaaagatataaccagacttcccttatacctattagaagcatgaaatgcacaggtacatgagaaaacaactttggtagacctgtgtatgttggcaaacacaaataatccattcattccagatactta

SEQ ID NO: 13941 - DNA, 279 bp, Homo sapiens
agatcatgaccattcatctcaacctcaggtctcaacctcaggtatgggcaatggccagtgggaaggcctggacacaaggagctggcattctgttaagcatgaatgtggaaaggttacccaagtgcataaggctgttcttgtgttgctataaagaaatacatgtctgggcacagtggctcccaaagtgctgggattccaggcatgagtcagtatgcccggctgacttgaggaacttctgtaagctccctcccttcatctcctgccaacctaagctgcatg

SEQ ID NO: 13942 - DNA, 485 bp, Homo sapiens
agtgagccgggaaggacagagacccaagtcccatccctctggggcccccttggaatgggggaggcgaacaggaaaccaccacaaacatgcccccccgccatcccaggagaagcagcagctctctgcctccttgactgagctccattacctccaagctgagagggttgttcaagagggcgtgtgggattcttttgaaaacacatttttagaaagcacccttttaacaactgaacatgatttggttgaaaataaacatccccgggtactcttgtggtacatgtttatgattttgatgcttctggtctgaatgtacaaccttcacattgtacattacaaacactactgtcaagtttatagattttcattttatttgctaattcattttccagttctctgcactgcttgtaaatcaggcaaacctgataaactgtctaaacatatgatgatactgaattgattaagttatggtcgtaggtgagaaaaca

SEQ ID NO: 13943 - DNA, 645 bp, Homo sapiens
tttttttttaagcaaaggcagctaccaaagtgttccgggcggggaggggggcgagggaggtgagtatgaggagtggagtggagctggacccttacaaagggacagcgacaaacacctcatactcaaaacaaggggactttccgtgtcatttgcgccgtcgggccattgcaaatgtccgcgctgagatgcctaccttgtcactcgacgcagccgccaaagctcacccggagctgcgtcagtccccactgggttcctccaggccaaggaggtacgacctccgccgcagcatataaagtaaatgtccaggagatgggaagaaacccgccgatacagcacccgggtgcccaagcccccgagaactaggccgcgcgggtactacggggtgcgcgatcggccagaaagcccgggccaggacgggcccaggagcgagcaccgtcgggaacaagcgtcgggaacaagccgggattaagaggaagcgccggcgccaacggtctcccgcccgccgcggtccccccaggactcttcctgcgcttgcaagcgccacgccgcccacaggactgcgccagccggccggcgcctcaacagagcgcgccacggagcagcgcccctcgggagacatgacgcctgagccatcgaggcggccgc

SEQ ID NO: 13944 - DNA, 353 bp, Homo sapiens
acattacaaaggaaaaggaagcagacagcattgttttcacagcatataagtatcacactggatgttattccatgcatgcattacagagtgtcagtaaaactagagcagacatcactgatggtaataaagttccctgttgccccgtggggacccatgactttttactctgttccacagctgctcgggatgtgccatttccaatgggcaaaaggcttggctgtacatatgtcttgaaactatttaatagttggaaatttgcctgcagtgtagcttcagcagctttgctaagtttttttttttttttaagggagaaggaacactaccccaactgccaagtctggaaagaaaaaaaa

SEQ ID NO: 13945 - DNA, 469 bp, Homo sapiens
catctcggcacgaggcttccttcaagcacgtggaccgacacccaggcctcctggtgtcctgacactgcagactcctggaatatacctccaccagcaggcaggaatctgtcctattcccagcaaccactagaggcactgcctgaccctactgcggccacaagcagagggaccccaggattctcaaatctgttaccttgtctcacctcccctaggaagcagaagagtgctatgaaaatctttagctgctgatcacagctataaacgagatgaggagggtccctgtcctcttggtgtttccagtctcccaaagaagacagacatgaaacaatgatggttacagttcaagatggaggtactatctgagcttatggcaaggggttttaatctcatccaaagggccaaggaatgcctctttaaagaagagagaacaaataaaaatcattcataattccatcacctataaataaca

SEQ ID NO: 13946 - DNA, 371 bp, Homo sapiens
gcaacaaaataattaggaaagaaaaaatggcgtcagtgtaagtacatcacatttctcattgcgttatttttctcatacactaaattaccttacataggtctggttctgatttactgtctgttaaatgcactcactgctaggataaaaatacccaaaaacatttgaatttctcataagaaatattggaattagaagaaaactattttaaaataacagttgttttaatattgttgggtacaccaactctttaaagttaatgttaatttttcccacaattttgtagagatagctttttcagcttttgttagtattttaaagtgtagcatacatgtcttaaggaaagaacaaggtgacatttcagtagcatttta

SEQ ID NO: 13947 - DNA, 446 bp, Homo sapiens
acttcgaccctccttctagcaatctccatttaacccaaaacaaagggcctcgatcacctgtacagcctgtgttccaagggatagggcagggatatggctgtccttcatagataagtagtgaatctcagtgttggctactcccggattccttagcctgggactccaaacacacttagaatagggtaattctcaggtatgctccagttatggctcagccatacaccaaggtgtatacaccaacccctgccatgcaccaatatgcatataaatatgaatagcctctgaaagggcgaattcctagattgacctataggcccacatgaaaagttctatattaatagctatgtcatgactgggtgcagtggctcatacctgtaatcccaacactttgggaggtcgaggtgggtggatcccttgaggccaggagttggagaccagcctgggca

SEQ ID NO: 13948 - DNA, 236 bp, Homo sapiens
tctctattgtaagaacttttcattattttatcttgtgtatataacttgtatcctctgctacctgccagtgcatcatcttctcttaacatctgttggttcttcctttgaaaaactcacgtcaggatgcttttgtgttttccccttttcaaaatttatatattcttctttgtcaagtgtaggttaattatgtcattttatagtgcaattgattaaagaaggcagattttaaaagataa

SEQ ID NO: 13949 - DNA, 388 bp, Homo sapiens
gtggggggaggagtgctattttatacatggtatgtctgataaggtgatatttgagtagagacctggggtaagggagccagctatgcagtagtaaggcatagtgagataagtaagacagagaaagcatcaggtggaaaagccccctagtaggagtgtgccggatatcttcaagtcacagaaggaggccactgtggccagtattcagtgaacaaaggtatagccataagaggtgagatcagagggggactggaggcccccatcatgtagggccttattaggacacaagaacagctcacctttacctgaatgagatgggagcctttggaaggttttgaatagacatataacatgattttgatttaaattgtacagtaatctctcaggctgt

SEQ ID NO: 13950 - DNA, 971 bp, Homo sapiens
caatgagtcactccctggctgctctgggttgtcacatcccaagctgagaccttgggaatgcgtaactggtttctgttcgctgatgcccgcctaatcctgggcactggcaggtaccaggagggctctgctgacgtcctcagctcccctcccagcttcacctttaccctcttcaaatctgggctcccctctttttcctccgttagactctcagtgttccttagggttcccctttacttgggtgtcctctgccctggggaagggattacaagcccaggctcaggtggtggtgtataacttggaggctggagggacctgtgataactccaggggcctcccagggcagccagactccccgctgtcctacctctacacctctgcttatgctgtgagtctgcctggaatgcctttatgtggctatcctgccccagccaatctcagcaagcccacctgctgtcccaccttcaatgtttctaaaatgctgtcaaaagctgcctcctccagcaagtctgcccagattgctcccaagtgaaatccttttaaaaagccccacagagcactttatctttttccttttatatcattaaatatttgtgaattcattcaagaaatattgagagaatacctgccaggcgtccagcactggagacccaggttgccatggcccctgctctggaggctttacagtccagtatggggtgggggaggcactaaacaaacacacttataattacaactgtggtaagtctacagggagacctggcctagtgtggggacatccggggaggcctctaagagaaagactgaggaggtacctgaagggtgtggagagtcttccttcccaggcaggaggaacagcccaggcccttctggctaacggctgggctggtctctggtggtcaaaggaagtgatagcagtgagccgagatcgcgccactgcactccagcctgaggacagtgagagactccatgtc

SEQ ID NO: 13951 - DNA, 326 bp, Homo sapiens
ccaagtgttgtaggtccttctgcacaaaagttccataccctcccttctcctttggttttctaatttaagtgtgatgagtagcagccagccaagtgaaagaaaggcccagggatttcaaaggaaagatacaaggctggcggcaaaaaggaagggctttctcctcactgggccctcttcagtggcttgaactgtgagactcctggaggtatcagcgcttggttcaaccctaaaagaagttgcatcagacatggcaactttggcctgctttgcttgtattctctgtggcgaatggagtattaataagtggctctctggggaagtttgcg

SEQ ID NO: 13952 - DNA, 337 bp, Homo sapiens
gacacctttcgtcctttctaatctcactttaattagatgcactcttccaagcaaattggcctttagctcagtaaatgattctacatttggccagagatccaagaatcacagtgcctgatacattctgtatcaccagtgggctcagccactactttgtactggatactttctgcagacagtcttaacactgattattctaagaatggaaggtacatgagtgattcatgtttcttctttaattgtatgtattttccagaatatctaaagtaaaaatgattaccacttacaattgcaaatgtaaccataactaaaaataaaaattgttttttaattccgt

SEQ ID NO: 13953 - DNA, 504 bp, Homo sapiens
agtgcgagttttcaaagtatctcttggattggggaaagtattattgagctttaaaaataatcccattaagttctgtcatttcctgtgacgtcttagaagtttgcccagggtgtaataataccaatgtgagagaggcagagagatactggggtttctaattaaaacgaaggctatagtgagtgcagggtgatgcgatccagcaactgagtcggtggggctgacggccgcatcactgattcagggtgagaggccgtcagataaggaggccctggcagctgggacctccctcaccaaacaccagctgatagcaggggcagcctactcgtggggaaggtggggctccttgcttttgccatctccctgccatcatccttcccggcttgtggtatccggcaggctttggttgggttttgtttgtagtaggatctccataagaggaagtatagcatggagctttgtgctcaaagccattctgggtcaggaaagccccagaaataaaatata

SEQ ID NO: 13954 - DNA, 875 bp, Homo sapiens
gagatagtctcgctcggacgctcaggttggactgcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaagccagggtgagcggtggctcaagcctgtaatcgcaagcaacactttgggaggcggcagctgggcagatcaccggagttcgggagttggagaccagcctgagcaacgtggagaaaccccatctgtactaaaaatacaaagttagccgggcgtggtggcacatgcctgtagtcccagctgctcgggaggctgaggcaggggaatcgcttgaacccgggaggcggaggttgcagagagcctagatcgcgccattggactccaggc

SEQ ID NO: 13955 - DNA, 1814 bp, Homo sapiens
gcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtctcgaaacaaacaaacaaaaaccaaccaaccaaccaaccaacaaacacagacaaagaaagaaagagcccaggcaacctagtgaaaacctgttcgggctggggcgtacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatctatcgtcgggaggaggaagagctgatcttacgcagggagggcaggtggactatgtgtggactctggtgacctgtttgggtgccaggtgttactcccagggccacccgtaactgtgaatgtgcaggaaccctgacttgagaagggcctggccacggggggcttaggcccctggggaatgagagtttggttcccggtacccagggaaaccaccagcatcggcagaggtgatagctgaggaggagcggggatttggacgagagacacaggatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctgtcgagcggccgccaatttagtagtagtagtaggcggccgc

SEQ ID NO: 13956 - DNA, 1940 bp, Homo sapiens
gctccgtaccctgtctcactttccggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtctcgaaacaaacaaacaaaaaccaaccaaccaaccaaccaacaaacacagacaaagaaagaaagagcccaggcaacctagtgaaaacctgttcgggctggggcgtacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatctatcgtcgggaggaggaagagctgatcttacgcagggagggcaggtggactatgtgtggactctggtgacctgtttgggtgccaggtgttactcccagggccacccgtaactgtgaatgtgcaggaaccctgacttgagaagggcctggccacggggggcttaggcccctggggaatgagagtttggttcccggtacccagggaaaccaccagcatcggcagaggtgatagctgaggaggagcggggatttggacgagagacacaggatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaagccagggtgagcggtggctcaagcctgtaatcgcaagcaacactttgggaggcggcagctgggcagatcaccggagttcgggagttggagaccagcctgagcaacgtggagaaaccccatctgtactaaaaatacaaagttagccgggcgtggtggcacatgcctgtagtcccagctgctcgggaggctgaggcaggggaatcgcttgaacccgggaggcggaggttgcagagagcctagatcgcgccattggactccaggc

SEQ ID NO: 13957 - DNA, 885 bp, Homo sapiens
gcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtcccaggaaaagcaggggatcctgtagagacgagcaacaaac

SEQ ID NO: 13958 - DNA, 885 bp, Homo sapiens
gcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccactgtgcccggcctgaagacagcctttagagaaagaagcagggggagttcttccgaggacagacaagatttctggagtttggaaagggtgagagactgggtcagcgaaaggaacattccggtctttatgtgtcctgaaggcctcggcggaaaccgtggaccccgcctcgctctgggagtactagggccggcctgccttccccgctcctgcccacatgcggctcacatgccaaccctcccggatatgcacgtccctgtaa

SEQ ID NO: 13959 - DNA, 1110 bp, Homo sapiens
cccttctttctctgtggcccgggccccagttctgaaccagctggaggagttgctgagcgacatgaaggcggacgtgacccgcctgcaatccacggtcaacccacgtggcttgaaccctgacttgagaagggcctggccacggggggcttaggcccctggggaatgagagtttggttcccggtacccagggaaaccaccagcatcggcagaggtgatagctgaggaggagcggggatttggacgagagacacaggatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaagccagggtgagcggtggctcaagcctgtaatcgcaagcaacactttgggaggcggcagctgggcagatcaccggagttcgggagttggagaccagcctgagcaacgtggagaaaccccatctgtactaaaaatacaaagttagccgggcgtggtggcacatgcctgtagtcccagctgctcgggaggctgaggcaggggaatcgcttgaacccgggaggcggaggttgcagagagcctagatcgcgccattggactccaggc

SEQ ID NO: 13960 - DNA, 2352 bp, Homo sapiens
gcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtctcgaaacaaacaaacaaaaaccaaccaaccaaccaaccaacaaacacagacaaagaaagaaagagcccaggcaacctagtgaaaacctgttcgggctggggcgtacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatctatcgtcgggaggaggaagagctgatcttacgcagggagggcaggtggactatgtgtggactctggtgacctgtttgggtgccaggtgttactcccagggccacccgtaactgtgaatgtgcaggaaccctgacttgagaagggcctggccacggggggcttaggcccctggggaatgagagtttggttcccggtacccagggaaaccaccagcatcggcagaggtgatagctgaggaggagcggggatttggacgagagacacaggatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctgaaaaaaaaaaaaaaaaaagccagggtgagcggtggctcaagcctgtaatcgcaagcaacactttgggaggcggcagctgggcagatcaccggagttcgggagttggagaccagcctgagcaacgtggagaaaccccatctgtactaaaaatacaaagttagccgggcgtggtggcacatgcctgtagtcccagctgctcgggaggctgaggcaggggaatcgcttgaacccgggaggcggaggttgcagagagcctagatcgcgccattggactccaggc

SEQ ID NO: 13961 - DNA, 171 bp, Homo sapiens
tttatggcttaaaagtcacttggttagactcaaacattgttgcaacatgctatatgttattcttaactaacattatacaaaatgcacaataaaggtagataatgaggatcttacacgttatttgtacatttattgaatacctatttataatcacgcatgatttctccgcaa

SEQ ID NO: 13962 - DNA, 2112 bp, Homo sapiens
cgcgggggcggggacgctgggcgcaggaggcgcggccgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgc

SEQ ID NO: 13963 - DNA, 2049 bp, Homo sapiens
cgcgggggcggggacgctgggcgcaggaggcgcggccgggagcgccgcgcgccgggagcggggcggcgggcgccggggctggcatggcgtggccctgtatcagccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcaaaaaaaa

SEQ ID NO: 13964 - DNA, 2033 bp, Homo sapiens
cgcgggggcggggacgctgggcgcaggaggcgcggccgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcaaaaaaaa

SEQ ID NO: 13965 - DNA, 1142 bp, Homo sapiens
cgcgggggcggggacgctgggcgcaggaggcgcggccgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacaggtatgggctgggtagggaccgcaacgagtccccaccctgtggtgggaggacgcggaggcccggctctctccggtcactgcctagtgtgcgggcgttggtggtgaggaccgagcgcagggtcccgtgtgggtgagcccttcagagtcccactgtgacaggggctttcagggagaacgggtccgcgggccctccccacctcccagcccagctctgctcctggacagccgagggctttctcccttttttcctcttaccacaaaagtaattcatactgtagaaaaatgggaaagtacagaaattacaacaaaatacgtatctccttgatccctccccagacgagttctttctactccgtaatgtgcatttggtgcatatgcactgatatatttttacgtggttagattcttactgtacacttttttcaccagttgtagaagtctgtccgtgttactacatgttctgcaacatgaattttaataaacgtgcagtattttatcctatggatatgcctttatatcttcaagttttatttatctacttccttaccattgactatttagggtgtttctaatgtgggactattaaaagcactacttttcctttgatgcagctatttcactactaggaattttccctacaggtatcctacaaggtaggg

SEQ ID NO: 13966 - DNA, 2165 bp, Homo sapiens
cgcgggggcggggacgctgggcgcaggaggcgcggccgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggtcccagaggtgaggaagaagttcactcctaacccctccgccatctttcaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcaaaaaaaa

SEQ ID NO: 13967 - DNA, 2114 bp, Homo sapiens
cgcgggggcggggacgctgggcgcaggaggcgcggccgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacagacaggaattccaggcttggactggagtgaagccctcaagatccacaaagacaaaaccagcccgagtcatcacaacccacacttcgggatgggacagcagccctggggccggcttccaggcctcagctccccggattctcaacgtgtgactgcctgcaccgtgacaccatggctgccgacaggacagggctggggagcggcctcaggacccactgccgcggggctgggcgagagcatggcatgggcccctgcgggagggcacagcccctctcaaagctgtcaccagggccaaagtgctggtgtggagcagatgcaccgatggacttggcacacccagctcagcctcaagcatcctcttgagaagcctgtggaaggctcctgcgttcgttaactgccatctggccgtctctcagttttgaaatctctgaggagcctgaggatcaagtcagttgggaaccgaattggtccatggaagctgaggaatgtggacacatccggcccttgaaagaaccagttatgtccacttttggtggatttcccaggatgcgtgagcacttgattaatttcataacctacagtgagacccttggctcttcctacaaatggcccctgcagttgaagctgttggaatcttgggccgtcacctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcaaaaaaaa

SEQ ID NO: 13968 - DNA, 1456 bp, Homo sapiens
cgcgggggcggggacgctgggcgcaggaggcgcggccgggagcgccgcgcgccgggagcggggcggcgggcgccggggctggcatggcgtggccctgtatcagccgcctgtgctgcctggcgcggcgctggaaccagctggaccgctccgacgtggcggtgccgctcactctgcacggctactcggacctcgacagcgaggagccgggcacgggcggcgccgcctcgcgcaggggccagcctcccgcgggcgcccgggattccggccgggacgtgccgctcactcagtaccagcgggacttcggcttgtggaccacgcccgccgggcccaaggatccgccgccggggcgcggaccgggggcgggcggccgcaggggcaaatcctccgcgcagtcctccgcgccacctgcgcccggcgcccgcggggtctacgtgctgcccatcggcgacgcggacgcggctgcagcagtgaccacgtcgtacaggtatgggctgggtagggaccgcaacgagtccccaccctgtggtgggaggacgcggaggcccggagccagagggatggggtgggcggcagagcggaggcgcctggagcccggatcccacgcgacctcggagctgccggcggcctcagaggtcacccccgtttggtccgtgggcactgcaggcggcgccttcgctgctccatgcccggactcagtgctcgagcacccccgtgccgggagcgcaccgctgccctcgcagccgccctcctgggggcagccgtcagaatggcctgccttcagccgagttggaaccggcctccctttaactcccaccgccgggcctagccgtgcgaggggtgcgcgcaggccatgtcccccagctctctccggtcactgcctagtgtgcgggcgttggtggtgaggaccgagcgcagggtcccgtgtgggtgagcccttcagagtcccactgtgacaggggctttcagggagaacgggtccgcgggccctccccacctcccagcccagctctgctcctggacagccgagggctttctcccttttttcctcttaccacaaaagtaattcatactgtagaaaaatgggaaagtacagaaattacaacaaaatacgtatctccttgatccctccccagacgagttctttctactccgtaatgtgcatttggtgcatatgcactgatatatttttacgtggttagattcttactgtacacttttttcaccagttgtagaagtctgtccgtgttactacatgttctgcaacatgaattttaataaacgtgcagtattttatcctatggatatgcctttatatcttcaagttttatttatctacttccttaccattgactatttagggtgtttctaatgtgggactattaaaagcactacttttcctttgatgcagctatttcactactaggaattttccctacaggtatcctacaaggtaggg

SEQ ID NO: 13969 - DNA, 258 bp, Homo sapiens
tacaggccccatgttaagtccaaaatccaacaggacagtcaaatcttaaagctccgaaatgacctcctttgactccacgtctcacatccaggtcacattgatgcaagaggtgggctcccacggtcttgggcagctctgcccttgtggctttgcatggttcagccctgctcccagctgctttcatgggctggcagtgtctacaacttttcaggcagacagtgcaaggtgttagtagatctacagttctggggtctggaa

SEQ ID NO: 13970 - DNA, 674 bp, Homo sapiens
ctgtgttttagctattcaataaatacgcttttatatgagcaatttaaaactagatagtcttaaataatgagttatgaattatgagcactagagcagatcagagtgttagatttttgtgaggacattcactacccatatgcatgttttaaaagaaaattgattgtaatcccagcactttgagaggctgaggcgggtggattgcttgaggccaggagtttgagaccagcctggtcaacatggtgaaaccccgtttctactaaaaatacataataattagccaggcatggtggtgcgcacctgtaatcccagctactcgggaggctgaggcaccagtattgcttgaacccaggaggaggaggttgcagtgagctgagatcacaccactgcactccagcatgggtgacagagcaagactctgtctcaaaaaaaaaaaaaaaaaaaagcgatttattgcattaaaatgccagatttattccctatggattttttttttttctggctgcaatgtggtgtcctataacaagaaaccaaaaaacagaaaaaactccttatctgcagatctctttaagaaaaggcatgcaactagaagatttgtagttcatgtgcttctgatttttgagtataatcttttcatgtaactacaattttgatttttagtaagtcttttaatgagg

SEQ ID NO: 13971 - DNA, 455 bp, Homo sapiens
gttaattgatttccacatacttcagttacacattttctaacagcattagccagacagagataaattggatacattggaataaatatagatgcattttctgcaggctatttttctaatataatagcaatttaacagtttgaagtgtcattatcaaatgtgtagtttaactcatacattttacaaatgcacaaactaggccaaatccagtttcaaactaagatattttattccataaacaatgcaatatctatcaaaaagcaccattgcacaattgtttgcgtaaataaaactgtctttgaacttgatatgttttgaaagtggccatacatttttgtattctgatttgtttttctggcatatagaacctttgaatctttagaattaaatataatgaaaaaaagaaaagtgatgaaaggttgaggactgtatttttattatcaatttttattgcactg

SEQ ID NO: 13972 - DNA, 359 bp, Homo sapiens
cagactcgattcatataaagatagatttttcaaatctaattttgaaaactggacattattttttcttaagaatgagcaccttaaatgagggtaacaacttgaaagtaaactattacttataagactttcccacagaaaagttgtaaaataaagatattgtgtgcattgtatatttgtgtataagatatatatctgtataaattcacattttaagataatttctgatttgttttgaggtagggtctcactctgtcagcaaggctggagtacagtgccatgatcatggctcactgtagcctcaacctcttgggatgaagcaatcctcctacctcagcctccagagtagctgagactgcagg

SEQ ID NO: 13973 - DNA, 2727 bp, Homo sapiens
caggaaaggatgcagggagcattggactgtaggaaattctcctttatacaagttaattagttttgtctctggtggctgtctcttaaaacagaatcccctggagacccgggttttcattttgtaattcaacacccaaatatttgcaacactaaataacaactccctaaagacttcagtcttgcatgggcataagcaactcacactggttagcttttgtcagatttcgtcgtttccgcagcaaaatttcttagtgttgatgttgatagcttctgggttggcaaactggcagttcactctagtcttactgggttgggcaagtccttgcccctagaaaattggggatagctttggccatgggaggagcaagaacactacgcagtcgtaagctctgttttttgttttgttttgttttgttttgttttcggcaccattatgtacgatgaagacttacagccacagcataggggacactttgaggagccctagtatcattgtttgaaatcattgtacagggaactgcaggggtgaacaccattgtaccaatccccgggccagtgtctcatttcctaacagaatcatcccattcttgttcactcttcagtcatcccaagccaaaagggaaaattcgaaacccactgtgacaccccaaccctaatttccaacctttggaggactcacctggggcagaagggagaaagggctttgctgaagtctcaggctgccgagagccatgtatgggcataggagcaagctgatggcatggctcttgacaaggttttctatagggcagcagctgctgctcccaggggaaccctctcctgttgcctccgcagtctattctggggtggaaacaccattctctattatttctctcacatacatgtggatttctaatatcaagttatgtgactgcctaccacttaaggcctacaaaaccacatgggagtttctttattgcgtatgcagccagtcaacatgaatgggaccctagaaactgtgaggagcaggattctctaaggtgctcttagatacggtgtcacttccacatacaagcacaattctcccagttaaggggctggaagacaagcggggcaactggttttgaaaagcccgctggcgtgccagagggggtgtttgcccacaccctccttgaatttaactgccacaatctatccgcagatgtgttttgttctatttcttgtttttcactagcgtttgcgttgcttcctctgaagccagagggtgaaaggccctagcaaagttagttatcagtcaactgatgataactgtgatccttaaagatgaattcccagcctgaggtgacacacagaggttcagcagacgtctcaggatctgtcatatgtcatgttgcttggtgtgaagatggaagaacaaagtccacatcagtttctgctccttcaaacagtgtgtcgatatgaaacattgagatttggcagaaacatgtgcctagtttgcagcaccaaatactggtcttctcagaagtgtttctgtttttttgtttttgtttttgtttttgttttgttttgttttgtttaatttcctcttctggcatcccaatttggatcatttcctctctttctttcctggagaaacaggatggcaggtgctggagcccagagagggggttaccctccagctaaaatgatttaaatggaaaggagaatgacagcaaagcctcacgtgaactttaatgaccttatcaatgacctttactaactgactcttggtacccggattgttgagaggtgagtgggactaaaagccaggatcaagatcaggttgctccacacatttgcagatcaggaaccccgggaatatgagttagacccagaaagtattgaactggacattgaatgaagcttgaggccatgcattgataacatttttagagtctgttacattattttctcaaaaggaacacatgtttactacaaaccatttagaaaataccaataaccaaacagaagggaaatgtctggaaccttccagttgtttaattctgtagaaactgttcacgaaaggctgaatgagtggggacaagtcacagagatctcgccatggttagcaccagggacaagtctggctctaatgtatgttttatgaagtctgattagctttgaaatgcatctttgccagctgaacttgtcatgcactaaacttcccattgatcattagagtgtctacgattaagtggaaaaggtggtcaaccatttggatgtttgactttcacaacatcaagcattggccattgggcgtatctgggcattggtatggaataaacaggatactcagtgaaacatccaaactattgactggatttttcccatggggcatctgtctaagagtcacagatctgagaaatagaaggaccaggtccgtgtggatgctcctagtgcgttcaaataacccttgaattcacccaggtctcattgcatttatttaaagatggagcccattgtcccccctcctcctcagctcacccatggaactagaaattcacaaacctgaagctgaaccacaggacaagaaattaaacagcaacggccacatggcctcttttttcacaggttttgcattgaatgttttagaactttattcccccgccccctcacccatgtataccaaaactggttttattttcattttcctaaattattttctgatacaataaactgttaactgtttatttatacttttaaaaaaaaa

SEQ ID NO: 13974 - DNA, 358 bp, Homo sapiens
tttttgtttgctgttgtcgttgttgttttagattgaagatctgtttggtattttcctcctctctagaattgattggccaatagtttagtttagtttatgtcagttacagagagaaacaggggtgaagaagagagagagtcttccatacgggttacaaagaaagggactgatctgaaaattaattttcaaaacacattaatttagaaaaaaatacacactaagcggtaaaattcactagctacttcaacaactgaagtcagattaggtgcagttttttaaattcactgcagatttcttagtgattagatatagtgatgaaatcctcaaaagattttggaagtagggaaaacacagtgcc

SEQ ID NO: 13975 - DNA, 292 bp, Homo sapiens
tctgtataataaagtaattgataagatgatatgcagttctggatttatgccagatacatgttttataagaaattttacatgggtaattacttaaaatataagattctggtgtattgaaatacgtatttgagtagcctgccattttaaagttataatgcaagttaacttctaaattttaataaaattttgagttttgtgaataccgttttcttcagcaaagctcaagtattaggctattcgtgtaaaactattatatctttgggcacatgtttcttaatatgattttaaaagg

SEQ ID NO: 13976 - DNA, 262 bp, Homo sapiens
catgatggaacatacacagggtgcggcagtcactagtgacactttgtagaagctcacttacagaatgagtttctttgtggctcttgtcaacccaaataaagatttgcgtcaaaaactgtcccttcttggtatctatgttaagagtaaagcttagcatatctaatgctaccctttcgctctaagtttaatgaaataaccatttaggtgaggggagtggccttagaaatttgggctaaatcaatggttccttggcagatcgctg

SEQ ID NO: 13977 - DNA, 360 bp, Homo sapiens
gccgccgcagccgccagcctcttcctgctcatgcttttcctcatcttcatctcggtctgagtgggctctggacctctccaccagcctctgccccagaactgttaactgcgggggggaaaaaaggaatttgtcgtcgcaacgcgcgttccgatggagccgcacgccacaaaggaagactcatgctgcaccccgcggggcagatgcggcgacactggacatcgctgcacagctgggtctgcccgtttccagagctgcttagcgccgacgcccataaatgaggaggactccctgtgtattaaaagggggatccgcagggtttaatttgataaggattatagccttcataaaggcatttttaac

SEQ ID NO: 13978 - DNA, 684 bp, Homo sapiens
ctcgggaggctgaggcaggggaatcgcttgaacccgggaggcggaggttgcagagagcctagatcgcgccattggactccaggctgggtaacaagagcggaacctccgtctgaaaaaaaaaaaaaaaaaaaaaaattgggagaattttgctcccactgccgtcaaaatcccacgtgtatttcacacttacagcacagctccattagaactgaccacatttccagggctccctagatacctgtggctagcggctgccatactacaccgtgctgggctgtagaatggggatgacaagacagggcggcggagattgtgttggcgtgaagcgagggaaacactcggccgcaggacaaaactaaaacagcaagggggcaccgaaagactcagtagtccacgtgaatatcctgattatgttgtagctgagataatgtagggtccacccctaccgggtctgtgggttttctcttcgcgtgtgtgcggagacgagagatcgaagagataaagacagaagacaaagagataggaagaaagacagctgggcccgggggaccactgccaccaaagcgcggagacagacaggtagtggccccgagtgcctggaggcgctgctatttattgtagtcaaggcaagggggcagggtaaggagtgccagtcatctccaatgatcgataggtcacgcgagt

SEQ ID NO: 13979 - DNA, 645 bp, Homo sapiens
tttcctagggaatgcagtcggatttttggtgaagatggtctgacgctgaaactctttcttaaaagaactgctcccttttctattctatggacttcgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtgggagcactggtcctcttttgctgctctgccatggggctgtctctgtggggatgggcagggctgtggctggccttcaacatcctggggtgaatgttgggggtggtgctgacatacccaatcctaatctccattggggacagtggctcagcgttcctggaaatgcag

SEQ ID NO: 13980 - DNA, 823 bp, Homo sapiens
tttcctagggaatgcagtcggatttttggtgaagatggtctgacgctgaaactctttcttaaaagaactgctcccttttctattctatggacttcgactaattacctttatttactggctttaaagaagctgacggccacggatgtctccgctctgttctgttgtaacaaagcctttgtcttcttgctgtcatggattgtgctgaaagacaggttcatgggagtgagggtaatggcatacttgattcaatgcgcgatgcctgcctttttcataactccttggcttcaggagagcctgtctgctttgtttcgtggagttgctgtaaaacttttctcacttgttctgagtacaaaccgaaatctgaagacgcattagaaagcccaggcagttgcaacatcatagaaggataaacagtttgtttccactggttagtgagctcattccaacaggaggcactaaaacaggcagagaaaacaagttcctatattagaattaatttttagaactaatggtgtgttcacctccttctgtcctcaggaacgaagggtctgagaaaattagccactataaagattatggtttgcatttttcaatcaacatatgttgagatgaccccccattccccccaccagatggacttaattaatattggtgtaagtagataagattaccaaacagtaattaaagtcactggtaatggcacaatgctgttaaaagtgactatatatctagtgtgactaatgcagaaatggaagtacaagcaacaacttcttttggatacaaatccttaattgaactgcattaaacttccaccaacaacttc

SEQ ID NO: 13981 - DNA, 746 bp, Homo sapiens
tttcctagggaatgcagtcggatttttggtgaagatggtctgacgctgaaactctttcttaaaagaactgctcccttttctattctatggacttcgactaattacctttatttactggctttaaagaagctgacggccacggatgtctccgctctgttctgttgtaacaaagcctttgtcttcttgctgtcatggattgtgctgaaagacaggttcatgggagtgaggattgctgggaagccctgaagatttaaggagccagatctcattcatataatccggcatgccactatgatgaacatattgagacaacacttctttagaaggagatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtgggagcactggtcctcttttgctgctctgccatggggctgtctctgtggggatgggcagggctgtggctggccttcaacatcctggggtgaatgttgggggtggtgctgacatacccaatcctaatctccattggggacagtggctcagcgttcctggaaatgcag

SEQ ID NO: 13982 - DNA, 194 bp, Homo sapiens
tccgaaagggacaaatggaacaaaaagagaagacttgctcagacattcagagtgggggacattgatggcattatgagtctcaccagaaacttttatgttcttcatatcctgtgacctctttatggaagaattaaactacaaaagaaccagggctgtaaacacagcatttttgaatcccctatgccgggacagcc

SEQ ID NO: 13983 - DNA, 492 bp, Homo sapiens
gagtgaagatgtgtgctgaagcctggaggtgagagttacggagggtggagggggagagagaagcctgagccattagcaggggcagagtctaaagggctctgcaaaccacttgaaagtccttggccttcatcctgaaggcagtgctgaggggcttgcgcagagagttgggctggttttgagtttactgtgtgccagtcctatgccaggctcttggcatgtcttacatcagagttacccacacggtaagtctgtgaaggaggtgtgatgctcatcttacagagaaggcaaccaaggcctagagaggttagagaacttgtctaaggtcacatggccagtaggtgacaacctgggcttggaacccaagtctgactctgaagcttgggctctgaaggtgtgcaccacactgccagactcatcagggcgtgtggctggtcagtgcaatgccaggacagcgaagacactagtctgcctgcaccagagggctagcctcag

SEQ ID NO: 13984 - DNA, 275 bp, Homo sapiens
  misc_feature (13)..(13): n is a, c, g, or t
  misc_feature (55)..(55): n is a, c, g, or t
  misc_feature (63)..(63): n is a, c, g, or t
gcctcgagccagngtgcctctgcccgggctgaccccgccctcggtcccggtcctngctccctntcctgcctctcctccctggcctggccttcacttcctgctgaccctcaggagggcgtaaaagaatgcaggacctgctgcattccagccaccctggcccagggtcccagaacaggatgagacaggcccctgaggcggcagtcctgaggaaagttgctggaattcctgctgacaacgcccccccttgaccccacccctctgaccaagccaggctc

SEQ ID NO: 13985 - DNA, 418 bp, Homo sapiens
gaacacaggagaaacattttaatgtttactaatatagtggcttatagttaaaaataaatgataaagaaaaggcatattaacttatcaaataatgattaagtgtgtactatgtgtctgccactgtgctgggccctggggggctaatcataagcaagaaagatacagtccttaccctcatggcaaaacctaatggggaagaggaaaaatactgaccaagcaataacaatggagtgagatgtgccaaaatggtgacagagagggacttttatgagtaatgtttgatctggtttctattctattaacaacagctccagtattatcttatttgctcagactctaaagtgtgttcatttttttttcactactccctgttacccttcaataagtgaactaattgaagggtaacagggagtagtga

SEQ ID NO: 13986 - DNA, 459 bp, Homo sapiens
gaggaaaccgcataggcaattggtgtctttatatgatagcgctagatcgcatgaaatcttacccttgaactcctaagttctaataaacaataatgtgatcgtgcaagttattcatcctctcttcacatcagtttccttgtccataaaatggagaaagttgtgtttatgcttgggaatggatagaacaagacaatgcaaggaaatgagcattgtaaactatttaacatgaagcgaactacattttagtagtatggcacaaaagcctaagaagttctgatcctatttccttctgtcatcatcatgctgtggtcccattaagcagtatcagttgccaacactgtgattgtgtgtgaagccaaggcagagacagaacaactggagctagtgatttatcttcaccaacttcgcccagcaacatcctgcctttcgtagaggacttcataaagcttttccattggc

SEQ ID NO: 13987 - DNA, 130 bp, Homo sapiens
ttttatttttaatctgtcttgattttgcttccttcctaaacagttttggcttcgtgatcacgtaaaccaagagtcacaaactgaaatgccatcaaggggccaagcaggtaacaaaattcaagtcatacag

SEQ ID NO: 13988 - DNA, 203 bp, Homo sapiens
ggttaatttttattgctgcatagtattcaagttaatgtatcttgttagtggatatttttgttgcttcccatttttttcttttacacagtgccactgtaaacacttttgtcatatatccttgtgcacacatctgagtttctcaaggatgattaataagagtggaatttctgggtcattgggaatgtgcatcttctttattaaat

SEQ ID NO: 13989 - DNA, 202 bp, Homo sapiens
gatgttttctggttttgtttttgttaatagagtatctttattaatacagtatctaatgcatcacatttacttgtcagatctctttatcatcctgtaatctagaaaagtttctccatctattttggagtggtgtttggtaaaattaacatttttagagaattcatacccactgttttattatttaaaataagaaatatttaaa

SEQ ID NO: 13990 - DNA, 802 bp, Homo sapiens
gtaaaggctttctaaggactgatctcagaggccaaagggcttttgaactggaaagtggtgccaaagtcagtgcctgctgtacgttgcctctgcatgtctctgagtccttttgagaggccagcggggagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttcccatgcataaactccctgcatcctcacagccgccctactgggcacccacattcttgtcgctatttaaacaagggcaaactgtgacacaaagggattaagtcactgtcctggggtcctgtgattaacaaatggcaacactaggatgtgaacacaggcatgtagctcccaagatccagcaagtgttcgcaggagatgcatccaccagtggaatgttctggaaggcactggtcccagactctgcgggagtcaagaggcccactt

SEQ ID NO: 13991 - DNA, 451 bp, Homo sapiens
gcttcaataccctgtattatctgggaacaacaacccctttccctgtactggcatcaacaagataaggtttccatggagctgccataatttttctataacgctgcccctaggccagaattggttggtctacaggtagatacctgatccaaactatgacaaccacaatattccagcccttgacaatgattgactcttccaggacgggcacttaactcaagctaggccaatcatagtcatttctcaactagatcctgccccactggtcatagctaattggtgcaggactggaactggatgcaagctgactctctggattgagaactagaggtcagaccattccctgtcccatgtctgaaactgaaatatgcagcactggaaaactgctcatgctcatggccatgggatcagccttccccttagcctcagaaggccttggagtggaagcaacagg

SEQ ID NO: 13992 - DNA, 607 bp, Homo sapiens
cccacacctccacgcaggcctggaaggcaggagagagcaagctttcttctcctttatttgtgaattatcagcacctagaaacttaagcgggcaaatgctgaattgctggagactgtgaagctgtgatacacacagagttgctccttcccttcctggctggggtgctggcctggggagcctcctgcccgggtcactccactgcgcatgctctgtggctaccgtgagactgacctgcctcagacacccttctccttgagcctcaagggcctcatggcctggacctccgtgatcagccagaggagcccagagtccatggtgctgtggcctcctgcccactctgggaccccagggagagggcctgtcctcgctgagcctccgacaccggttctgagcctcttggacaacattttctctccagtttacaagtaggagccccttgcataaataagatggggaaaatccctgcagatgacatggccggggccctgggccccgggagccatttctgttccttgtcactcagcctggccagtccttgagtttttccccagagtgtcctcaataaggaatagcaagcctgggtattttcttctggtcagtattccgt

SEQ ID NO: 13993 - DNA, 282 bp, Homo sapiens
gattttaggagttgtatgccaagaaaaggtgggtggggtggaagaccaaatatatattttacaatatcacatacacaaaagaaatacatatggccaaggaagagactgaaatgtattcatggcctgacgcagcagctcacctgtagtcccagttactccggaggctgaggtgggaggattgcttgagcacaggaattcaaggttacggtgaactatgatcacaccagtccactctagccttggtgacagagcaagaccctatctctttaaacaaaaaagaaa

SEQ ID NO: 13994 - DNA, 414 bp, Homo sapiens
gcaagttacctggggagaaattacacaaggctgtgaacaccaggaggcggggacactggggggcttcttagaagctgccaatcagagtagatatagacaaacggattttaaaatttttatggaaaggcaaagttactataatatctaaaataaatctgaaggaaagtaaaaaggtgaagcaaatatactacccattttttagacatatgaaaaaacgacggtaatcggggcaatgtcatttagcctcaaaaacagatgaatagatcaatgcaatagaatagagagtccagaaatggacccatacaaatatggccaattgatttttgacagaggtgcaaaaatagttcaatggagaaaacatcctttttaacaaatggtattgaaactattggacatccatatgcaaaaaaataa

SEQ ID NO: 13995 - DNA, 1189 bp, Homo sapiens
ctggagtgcagtggtgcaatctcagctcattgcagccttaacctcccagctcaagcagtcctctgacctcagcctcccaagaacctaccaccatgtgcatcaccacgcctggctaatatttgtactttttgtagatatagggttttaccacgttgcccaggctggaggcataatttttaaactgcagatgattttaattcagaattgtgaagaccctcttccatagacttggagattccaacttgctacggaacagtctcttatcatttggataccttttcctttacatgggattgtgtttagtattggaaagcttttaggattttaagaaaatgtgattcctaattgatgttttctttaaaaagttatctctcttaattcattttctaatgcttatatggctacccagttatcctagcactttttatagaaaaatttgtatttttcagactcagtgcaaggtaatttctaagttgttttcttccccattgtttgtctgtctttgcgtcagtggcattcttcttattgctttgctaaaagtcttgatatccagtagagtgagtccttccaccttggacattcttagccctttccatttgtttccatttgttacaaattttagaatcagcttttctaagaatcagcaattttccagagaaaaatctgtttggattttgattgggattgcaatgaacttatgatctgtttggacgaatttgcatctttacaatgttaagtcttccagtccagtatctactccattgaggtctgctttaatatctttcaaagttttatagttctctccagaaagataataaacacttttgttagacttattcctaagtacatgatagttcttggtgcttttataaatggtagcttttaaatttcattttctggccgggcacaatggcttgcccctgtaatcgcagcactttggggggctgaggtgggcggatcacttgagattaggagttcaagagtagcctggccaacatggcgaaaccctgtctactaaaaatacaacaattagccatatgtggtggcacgtgcctgtaatcccagctactcaggaggctgaggcatgagaatatcttgaacctgggaggcagaggttgcaatgagccgagattataccactgcactccagcccgagtgatggagtgagactctgtcctcaaaaaaaaaa

SEQ ID NO: 13996 - DNA, 292 bp, Homo sapiens
actatgacctcaacaggacactgttctatggggaggccaaccagccacttggttgcaagttgagcatttaggatcattccaaaaaggggagcagttggttttgagtaaggctcatgtaaaatttgcttttcttgctaacaatggctaggaccacactactagttaaggatagtattgttcacagatatattgacatgggaccctgtattatatactcacaggcaaagaaacctgttttatggtgaaagaggtgtgttaatggacacaagacgattgcatactaaaccccata

SEQ ID NO: 13997 - DNA, 4476 bp, Homo sapiens
  misc_feature (2558)..(2558): n is a, c, g, or t
  misc_feature (2696)..(2696): n is a, c, g, or t
  misc_feature (3176)..(3176): n is a, c, g, or t
  misc_feature (3720)..(3720): n is a, c, g, or t
tgcgagttttgcctctctcactggcagcaacccagcgcttccattgctgacctctaccgacctctacctgtggtccttcctctactgcagcagagacactgttttcttcctttgttcttccaaccccatggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatctagaatgtttttcatacatatatatgcttcttgggactctccctgcaggttaagagaaattgagaaacgatggagaatttaagtgttttagatcctacatacattagacttaaaaatagtaactatgtacatgagtatttgtaaacttaagaatgaacataacatgaaccatgtggcacctataaaatgaaaataaaatacctacaaaccaaatgagagcaataaaagaagctttaaggactttcacttcagggagtctgaattagatgcgcttcttcccattcctccctctaattacaacaagcttggacgttacatacagaacaaacagaaggagtctctgaaagatgaagagaaggcaagtaagctacagacttcacaatgtaaggaataatatggtggtgagttacatttgtgatttttttttgtctcatatcccataatatctcatatctcataatcagttagaaagcacaatggaaaagtattccactgccaatggtgttagagaactgctcacaaattcaacagaaatgcacagataccaaagcagaaaggacaataaacaagagtcttcatggtcaaaagattagaagctgcagctttcaatgggagggacaggttctggaccacactgcagtgcttttctgctttctgtgctttcccactctagagctgaagaaggtaacgaccccaaaatgtcaatatacgtagaccaaaaaccagccccaataaaagtctgctctctctagccaaaggactacagtagggcagcccagcaagacagaaaaccttcagacaacctaccccagccaaacactaccaaaaaaagtaaagtgagccatcacccaatccacatcagtaaaaactaagtggaaagtccagactttcacctcaagaggttgcgacaagctactccaatacccctgctgggatagtgtcacagaaggctaaataaggagctgtaatgttgattcccctccagaagtaaagagtccgtacctgctattttcagagagaccacatggaaagcctagatttcaacacctacccagcattaatgaggtattccttcccttctttactctctggtgtcaaagaagctccatgcagagtcagaatgtttggcattactcctcagtagggaggccacccccaccacggtgttagtggagaccatgtgaggaccaggacttgtaccctgcccagaagtaatgagtagacccccctctacaggaaggccaaagggcaacctaaacttctacctctctctggcagtaataaagtagggcctcacttttccctgctgagcaatgtcaaaaaaaaaagccagctgaagtaaaagcttatttctttctttctttatacatatttttggagacagggtcttattctgtcacccacgctggagtacagtggcctcatcaggtctcactgcagcctcaacctcctgggctcaagcaatcctcccacctcagcctcttgagtagctgagaccacagatgtgcaccaccacacatagctaacattaacattttttctagagatggggtcttcctgtgttgcccaggctggtctggaactcctgggctcaagtgatcctcccaccttgacctcctggagggctgggattacaggtatgagtcatcactccaggctgaagctttatataataaccagagtctcatattacaaaatgtcaaagattcagtcaaaagttacttgatatcaatggacaactcaaactaaatgaaaaaaagacaattaatagatgctaacactgagataacaaagttgttagaatcatctaacaaagattttaaagcagctataataaaagtgctactgcaagtgattataaacatgcttgagacaaatgaaaaagtgctataaagctaagaaataaaatatataaataagaatcaaagagaanttatagaactaaaagataccataactgaaatgcaaagctccgtggatggactcaacaacagaatggaaaagactgaggaaagaagtagtttacaggaaattagaatagactagaaaaaatgaacaagaccctgtgctnaagagcaaatatttatgtcattggattccaggaaagagaaaagaatgaaaaagtacttaaataatggcttaaaaacttctcacattttgcaaagatttaaacctacaatttgagaagctgggtaaaccttaaacaggataaatcaaggacactcacaccaagaaacatagtaattaaacttctgattaaggaagaaaaagaaaaatctggaaagcagcaagaaaaaaatgacacactttctatatggtaaaagcaatttgaacaacagaagatttctcatcagaaactgtggggaccatgaggaagtaacagatatttttcaagtgctgaaataaatcaactgtcaatacaaaatgctctactcagtgaaaatatctttcaggaataaaggggaaatcaggacacgcacagactttttttaaattaagaatttattgtcagcttatctccctaaaagaatggctaacattctccaaacangaaggaaattgataaggaatcttgaaatttcagttagaaacaatgaatatggcaagcaaaatgtaggtcagtacactaagtttaatttctcctcttgaattttctaaattatgacttatgattgaagcaaaaatcataacattatctgatgtatatgtagaggaaagatttaagacagtgatgttataaatgaggggagtaaaggaacatgagataaccactaatatgacataccaatagactatgataaattatgtgtctaatgtgattactagaaaaaccagttaaaatataaagattgacggagtgaatttaaaaacatgacacactatatgctgtttatcataaactcactttgaagataatgccatcgtcaggttgaaatcaaaaggaataaaatagtgtattatgtaaaccatcaaaaagagcaggaatggccatattaataacattaaagtcagcttcagaactaaggaaattatcagagagggacattatataatgaaatagtcgatttaccaaaagaacatagcaatcataaatntgcatgaagcaaacaacaaagctggaaaatatatgaagtgaaactgatagatctaaaaggagaaacagataaatccattcattatagttggggcctttatcacccctcactcaacaattgatagaactggacagaaaaccagtaagaatataaaagaactcaacaacatgagacaataggatctagttgatatttatagaacattccaacagcagaatacatgttcttcaagtgctcacagaacacacatataaagatagaccctgagcataaaacaagcctcaacaaatttaaaagaactgaaatactacaagtactttctccaaccacaaaagaaccaaactagaaataaataacaatgataatgggaaaatcaccaaacacttgaaaactgaacaacaatattttataacccatggtcatagaggaaatctcaaaagaaattttaaaaatgcactgaactgaatgaaaatgaaaacaacataaaatttgtgagacacataaagcagaactgatgggaaaatatatagcactaaatgcatgctctagaaaagaaaagtcttcaaccagtaacctaagcttccacctcaaaaacctaaaaaaagaaggaaaaatagacccaatgccagcagaaagatgcaataacaaagagtagaactcaatgaaattgaaaacagataaacactttaaagaataaaacaaagagctggttattagaaaagatcaattaattgataaacctcaagcaagaccgtc

SEQ ID NO: 13998 - DNA, 4448 bp, Homo sapiens
  misc_feature (2530)..(2530): n is a, c, g, or t
  misc_feature (2668)..(2668): n is a, c, g, or t
  misc_feature (3148)..(3148): n is a, c, g, or t
  misc_feature (3692)..(3692): n is a, c, g, or t
tgcgagttttgcctctctcactggcagcaacccagcgcttccattgctgacctctaccgacctctacctgtggtccttcctctactgcagcagagacactgttttcttcctttgttcttccaaccccatggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatctagaatgtttttcatacatatatatgcttcttgggactctccctgcaggttaagagaaattgagaaacgatggagaatttaagtgttttagatcctacatacattagacttaaaaatagtaactatgtacatgagtatttgtaaacttaagaatgaacataacatgaaccatgtggcacctataaaatgaaaataaaatacctacaaaccaaatgagagcaataaaagaagctttaaggactttcacttcagggagtctgaattagatgcgcttcttcccattcctccctctaattacaacaagcttggacgttacatacagaacaaacagaaggagtctctgaaagatgaagagaaggcaagtaagctacagacttcacaatgtaaggaataatatggtggtgagttacatttgtgatttttttttgtctcatatcccataatatctcatatctcataatcagttagaaagcacaatggaaaagtattccactgccaatggtgttagagaactgctcacaaattcaacagaaatgcacagataccaaagcagaaaggacaataaacaagagtcttcatggtcaaaagattagaagctgcagctttcaatgggagggacaggttctggaccacactgcagtgcttttctgctttctgtgctttcccactctagagctgaagaaggtaacgaccccaaaatgtcaatatacgtagaccaaaaaccagccccaataaaagtctgctctctctagccaaaggactacagtagggcagcccagcaagacagaaaaccttcagacaacctaccccagccaaacactaccaaaaaaagtaaagtgagccatcacccaatccacatcagtaaaaactaagtggaaagtccagactttcacctcaagaggttgcgacaagctactccaatacccctgctgggatagtgtcacagaaggctaaataaggagctgtaatgttgattcccctccagaagtaaagagtccgtacctgctattttcagagagaccacatggaaagcctagatttcaacacctacccagcattaatgaggtattccttcccttctttactctctggtgtcaaagaagctccatgcagagtcagaatgtttggcattactcctcagtagggaggccacccccaccacggtgttagtggagaccatgtgaggaccaggacttgtaccctgcccagaagtaatgagtagacccccctctacaggaaggccaaagggcaacctaaacttctacctctctctggcagtaataaagtagggcctcacttttccctgctgagcaatgtcaaaaaaaaaagccagctgaagtaaaagcttatttctttctttctttatacatatttttggagacagggtcttattctgtcacccacgctggagtacagtggcctcatcaggtctcactgcagcctcaacctcctgggctcaagcaatcctcccacctcagcctcttgagtagctgagaccacagatgtgcaccaccacacatagctaacattaacattttttctagagatggggtcttcctgtgttgcccaggctggtctggaactcctgggctcaagtgatcctcccaccttgacctcctggagggctgggattacaggtatgagtcatcactccaggctgaagctttatataataaccagagtctcatattacaaaatgtcaaagattcagtcaaaagttacttgatatcaatggacaactcaaactaaatgaaaaaaagacaattaatagatgctaacactgagataacaaagttgttagaatcatctaacaaagattttaaagcagctataataaaagtgctactgcaagtgattataaacatgcttgagacaaatgaaaaagtgctataaagctaagaaataaaatatataaataagaatcaaagagaanttatagaactaaaagataccataactgaaatgcaaagctccgtggatggactcaacaacagaatggaaaagactgaggaaagaagtagtttacaggaaattagaatagactagaaaaaatgaacaagaccctgtgctnaagagcaaatatttatgtcattggattccaggaaagagaaaagaatgaaaaagtacttaaataatggcttaaaaacttctcacattttgcaaagatttaaacctacaatttgagaagctgggtaaaccttaaacaggataaatcaaggacactcacaccaagaaacatagtaattaaacttctgattaaggaagaaaaagaaaaatctggaaagcagcaagaaaaaaatgacacactttctatatggtaaaagcaatttgaacaacagaagatttctcatcagaaactgtggggaccatgaggaagtaacagatatttttcaagtgctgaaataaatcaactgtcaatacaaaatgctctactcagtgaaaatatctttcaggaataaaggggaaatcaggacacgcacagactttttttaaattaagaatttattgtcagcttatctccctaaaagaatggctaacattctccaaacangaaggaaattgataaggaatcttgaaatttcagttagaaacaatgaatatggcaagcaaaatgtaggtcagtacactaagtttaatttctcctcttgaattttctaaattatgacttatgattgaagcaaaaatcataacattatctgatgtatatgtagaggaaagatttaagacagtgatgttataaatgaggggagtaaaggaacatgagataaccactaatatgacataccaatagactatgataaattatgtgtctaatgtgattactagaaaaaccagttaaaatataaagattgacggagtgaatttaaaaacatgacacactatatgctgtttatcataaactcactttgaagataatgccatcgtcaggttgaaatcaaaaggaataaaatagtgtattatgtaaaccatcaaaaagagcaggaatggccatattaataacattaaagtcagcttcagaactaaggaaattatcagagagggacattatataatgaaatagtcgatttaccaaaagaacatagcaatcataaatntgcatgaagcaaacaacaaagctggaaaatatatgaagtgaaactgatagatctaaaaggagaaacagataaatccattcattatagttggggcctttatcacccctcactcaacaattgatagaactggacagaaaaccagtaagaatataaaagaactcaacaacatgagacaataggatctagttgatatttatagaacattccaacagcagaatacatgttcttcaagtgctcacagaacacacatataaagatagaccctgagcataaaacaagcctcaacaaatttaaaagaactgaaatactacaagtactttctccaaccacaaaagaaccaaactagaaataaataacaatgataatgggaaaatcaccaaacacttgaaaactgaacaacaatattttataacccatggtcatagaggaaatctcaaaagaaattttaaaaatgcactgaactgaatgaaaatgaaaacaacataaaatttgtgagacacataaagcagaactgatgggaaaatatatagcactaaatgcatgctctagaaaagaaaagtcttcaaccagtaacctaagcttccacctcaaaaacctaaaaaaagaaggaaaaatagacccaatgccagcagaaagatgcaataacaaagagtagaactcaatgaaattgaaaacagataaacactttaaagaataaaacaaagagctggttattagaaaagatcaattaattgataaacctcaagcaagaccgtc

SEQ ID NO: 13999 - DNA, 595 bp, Homo sapiens
tgcgagttttgcctctctcactggcagcaacccagcgcttccattgctgacctctaccgacctctacctgtggtccttcctctactgcagcagagacactgttttcttcctttgttcttccaaccccatggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatcttacaaaaaacaaaacacaacacacaccacacaaacaacccccttttgcggcccccctcgcgccccgcgggaacctctcatagaac

SEQ ID NO: 14000 - DNA, 4408 bp, Homo sapiens
  misc_feature (2490)..(2490): n is a, c, g, or t
  misc_feature (2628)..(2628): n is a, c, g, or t
  misc_feature (3108)..(3108): n is a, c, g, or t
  misc_feature (3652)..(3652): n is a, c, g, or t
tgcgagttttgcctctctcactggcagcaacccagcgcttccattgctgacctctaccgacctctacctgtggtccttcctctactgcagcagagacactgttttcttcctttgttcttccaaccccatggcacagaaacactctccactgcggccaaggattgcaggagaggtggcatcagtgattcaagacttcttttcctacctcttcagtgtttctttcagtgatctgaagttaaagccagggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccagatgttcgggtccaattcaccagaatgccaagttatacagggttgtggaatcaaaaactgcaattagtaataaaatgtgatgctatctagaatgtttttcatacatatatatgcttcttgggactctccctgcaggttaagagaaattgagaaacgatggagaatttaagtgttttagatcctacatacattagacttaaaaatagtaactatgtacatgagtatttgtaaacttaagaatgaacataacatgaaccatgtggcacctataaaatgaaaataaaatacctacaaaccaaatgagagcaataaaagaagctttaaggactttcacttcagggagtctgaattagatgcgcttcttcccattcctccctctaattacaacaagcttggacgttacatacagaacaaacagaaggagtctctgaaagatgaagagaaggcaagtaagctacagacttcacaatgtaaggaataatatggtggtgagttacatttgtgatttttttttgtctcatatcccataatatctcatatctcataatcagttagaaagcacaatggaaaagtattccactgccaatggtgttagagaactgctcacaaattcaacagaaatgcacagataccaaagcagaaaggacaataaacaagagtcttcatggtcaaaagattagaagctgcagctttcaatgggagggacaggttctggaccacactgcagtgcttttctgctttctgtgctttcccactctagagctgaagaaggtaacgaccccaaaatgtcaatatacgtagaccaaaaaccagccccaataaaagtctgctctctctagccaaaggactacagtagggcagcccagcaagacagaaaaccttcagacaacctaccccagccaaacactaccaaaaaaagtaaagtgagccatcacccaatccacatcagtaaaaactaagtggaaagtccagactttcacctcaagaggttgcgacaagctactccaatacccctgctgggatagtgtcacagaaggctaaataaggagctgtaatgttgattcccctccagaagtaaagagtccgtacctgctattttcagagagaccacatggaaagcctagatttcaacacctacccagcattaatgaggtattccttcccttctttactctctggtgtcaaagaagctccatgcagagtcagaatgtttggcattactcctcagtagggaggccacccccaccacggtgttagtggagaccatgtgaggaccaggacttgtaccctgcccagaagtaatgagtagacccccctctacaggaaggccaaagggcaacctaaacttctacctctctctggcagtaataaagtagggcctcacttttccctgctgagcaatgtcaaaaaaaaaagccagctgaagtaaaagcttatttctttctttctttatacatatttttggagacagggtcttattctgtcacccacgctggagtacagtggcctcatcaggtctcactgcagcctcaacctcctgggctcaagcaatcctcccacctcagcctcttgagtagctgagaccacagatgtgcaccaccacacatagctaacattaacattttttctagagatggggtcttcctgtgttgcccaggctggtctggaactcctgggctcaagtgatcctcccaccttgacctcctggagggctgggattacaggtatgagtcatcactccaggctgaagctttatataataaccagagtctcatattacaaaatgtcaaagattcagtcaaaagttacttgatatcaatggacaactcaaactaaatgaaaaaaagacaattaatagatgctaacactgagataacaaagttgttagaatcatctaacaaagattttaaagcagctataataaaagtgctactgcaagtgattataaacatgcttgagacaaatgaaaaagtgctataaagctaagaaataaaatatataaataagaatcaaagagaanttatagaactaaaagataccataactgaaatgcaaagctccgtggatggactcaacaacagaatggaaaagactgaggaaagaagtagtttacaggaaattagaatagactagaaaaaatgaacaagaccctgtgctnaagagcaaatatttatgtcattggattccaggaaagagaaaagaatgaaaaagtacttaaataatggcttaaaaacttctcacattttgcaaagatttaaacctacaatttgagaagctgggtaaaccttaaacaggataaatcaaggacactcacaccaagaaacatagtaattaaacttctgattaaggaagaaaaagaaaaatctggaaagcagcaagaaaaaaatgacacactttctatatggtaaaagcaatttgaacaacagaagatttctcatcagaaactgtggggaccatgaggaagtaacagatatttttcaagtgctgaaataaatcaactgtcaatacaaaatgctctactcagtgaaaatatctttcaggaataaaggggaaatcaggacacgcacagactttttttaaattaagaatttattgtcagcttatctccctaaaagaatggctaacattctccaaacangaaggaaattgataaggaatcttgaaatttcagttagaaacaatgaatatggcaagcaaaatgtaggtcagtacactaagtttaatttctcctcttgaattttctaaattatgacttatgattgaagcaaaaatcataacattatctgatgtatatgtagaggaaagatttaagacagtgatgttataaatgaggggagtaaaggaacatgagataaccactaatatgacataccaatagactatgataaattatgtgtctaatgtgattactagaaaaaccagttaaaatataaagattgacggagtgaatttaaaaacatgacacactatatgctgtttatcataaactcactttgaagataatgccatcgtcaggttgaaatcaaaaggaataaaatagtgtattatgtaaaccatcaaaaagagcaggaatggccatattaataacattaaagtcagcttcagaactaaggaaattatcagagagggacattatataatgaaatagtcgatttaccaaaagaacatagcaatcataaatntgcatgaagcaaacaacaaagctggaaaatatatgaagtgaaactgatagatctaaaaggagaaacagataaatccattcattatagttggggcctttatcacccctcactcaacaattgatagaactggacagaaaaccagtaagaatataaaagaactcaacaacatgagacaataggatctagttgatatttatagaacattccaacagcagaatacatgttcttcaagtgctcacagaacacacatataaagatagaccctgagcataaaacaagcctcaacaaatttaaaagaactgaaatactacaagtactttctccaaccacaaaagaaccaaactagaaataaataacaatgataatgggaaaatcaccaaacacttgaaaactgaacaacaatattttataacccatggtcatagaggaaatctcaaaagaaattttaaaaatgcactgaactgaatgaaaatgaaaacaacataaaatttgtgagacacataaagcagaactgatgggaaaatatatagcactaaatgcatgctctagaaaagaaaagtcttcaaccagtaacctaagcttccacctcaaaaacctaaaaaaagaaggaaaaatagacccaatgccagcagaaagatgcaataacaaagagtagaactcaatgaaattgaaaacagataaacactttaaagaataaaacaaagagctggttattagaaaagatcaattaattgataaacctcaagcaagaccgtc

SEQ ID NO: 14001 - DNA, 576 bp, Homo sapiens
tgcccaaggtcaccaccctcttgccaagggggtcacttggatctaatgattggttaatgctggggggagggggtaagtcttggcccccagcctcaacagtgatggcggtggctccggggtcatcctagcttccgagtttcgtctaggttgagggcgccatgttgggactgcatcagcttctctctctgcctggttctgcttcctttactttaccatttgttgttagtccagggcacaccccagtaaacttcctgcatgcgagttcatcttagactgcttcccagggaatcgtatgtacaacactcgggagtagagagtcactgaaacggccctagctctgagagacccctcctgaccagccatcacccctcccgctcttccttactctgatttattgtcttcgtagaatttaactctcaggtctatggccatactgccctgaatgcgcctgatcttgtctgatttcagaagctaagcagggtcgtgcccggttagtacttggatgggagaatttagtgctcgaacactattgctgtagctttctttaataaataaatttgactgccattcctgcta

SEQ ID NO: 14002 - DNA, 504 bp, Homo sapiens
tgcccaaggtcaccaccctcttgccaagggggtcacttggatctaatgattggttaatgctggggggagggggtaagtcttggcccccagcctcaacagtgatggcggtggctccggggtcatcctagcttccgagtttcgtctaggttgagggcgccatgttgggactgcatcagcttctctctctgcctggttctgcttcctttactttaccatttgttgttagtccagggcacaccccagtaaacttcctgcatgcgagttcatcttagactgcttcccagggaatcgtatgtacaacactcgggagtagagagtcactgaaacggccctagctctgagagacccctcctgaccagccatcacccctcccgctcttccttactctgatttcagaagctaagcagggtcgtgcccggttagtacttggatgggagaatttagtgctcgaacactattgctgtagctttctttaataaataaatttgactgccattcctgcta

SEQ ID NO: 14003 - DNA, 396 bp, Homo sapiens
gcacaaataactcttaaacagggcaatagttggtacattcctagttgatttctcctttacatttgtcaaacaagacttagtattcatagttctctatctgcaaaacatcctttacaaagatttgaaaagaaaagcaatcctttaaataattctttataacattccattagcctcaggcatatttttatagtcaattaaacacaggcttttctaatgggacattgattctcatttccatacacaattgcctccataagagcctgggtaatgccatctctggcacatgtccaataatccctgtcttcagggcagtggtactggtcaggaactttttctagactttaatcttaagcaaagccagtcatataattttaggtattggctttatctgctagg

SEQ ID NO: 14004 - DNA, 505 bp, Homo sapiens
gagatattaaccttttctgatgccttttatcaatccaatctctatgttaggcacgtaccttttaatgctattttattttgggatcatacttgcctgatcatctctcaattagagtgattccaaacatttttccacggagaatactgcgcctacctaaaggaagcccttaggctgcctctcagtcttagtgaagtgactgctactaggagtgtgagttgcccactcaatttactaaaggaatgtcccctctacctcccctcttaattattgattaaggcaaatggatctttatttcattggcaacctgggaggagtagtagtccaaccacttcccagggcaacatagagcgatggtcgctatataaatgcttaaatgaacacaggccaggggacccatgggagccacctgggaccatgccatgtggaactagccagtgtgaagcatgggttctggggacatcagaatgagattgtgtctacagaaagtttgttaggaaagactgac

SEQ ID NO: 14005 - DNA, 556 bp, Homo sapiens
gcatatagctagtgtaagcatacctctggtttgccctgaatagttatgggttacatctgttttcccaaaacaataatagctccccctttcacacacgcacaaaaattgtctcatttgtatgataaacttgtgtgcctcctacacatagccctgtgaattcgattttgaatcacagcatggatggagatcaacaaagttgtatagatattgaagtgttggctgggggggcgctattcatggagaatcccctccttaattctgcaaaccagatctagtacattgtgaatattctataatcattggctattttttacagctagcttttcagatctatacctgcttatgtacatgaaatgtagctcctgtaaattgcagattagtgtatattaatctaagatgccatcaactgtaaaatacctgttattttctataccacgaagaaaggatactgccaattaaactttggtatgcattgttggtaaaatgcatcctatttgtggaaaaaaattagcattttaagattaatacaatacaatacctgtaaagctctataaga

SEQ ID NO: 14006 - DNA, 644 bp, Homo sapiens
gaaaatcaatgcttagtaatgagcactgtgtgcaacactaaatattccttaatgtggggaaaaggaagaaagcaatttgttataattaagcaattgaagacaccctttttagacagatattttttcagctctgtatctattttatgactgtgcaacatgtcatttaagaaaaaatcccatcttcaatggtcatacttcactcaacagtaacagaatacaccacccaataatatgccactttgacattaggattatttttaaggattattttgagctaaacacatttgggaaatagacaatgcaaaaaagggcattctaaacctcccttttcttcctaaaatcagattaaaaactcccttgttaaagatacctccttcccccataaaagtggtcatagccaagagaattctatgcaaacatactttgttaaaataattctcatcttgttttagcctccccacataatttagttactgttacacaattgcctctttttgttcaacctgttataaaaacttttagcgctaggtgcaatggatcatgcctgtaatctcggcactttgggaggtggaggtgggagaatcccttgtgcccaggagttcaagaccagccttggaaacataacgagaccgccatctctaaaa

SEQ ID NO: 14007 - DNA, 790 bp, Homo sapiens
cttcctctctgggccgcgagcccctcttgtgattggtaagacctttccagctgtgacaggctgagcccaactcgactctgtgaaacgtaccccaccccccagcccttcttccagtccccctcttccatgaggagacccactctgctcccaccctctgaaaacctaaagcacagcccaaatcccccaccccagcagcatacctagggagctcctagtcctggtaaaacggcaggagtaggtgctggggatgctgagaaaggaacaggaatcctgtccaggcaggtcctacctctgcccatgtggctggccctcatgtctgggtcttctcactctactctcattactcctccgggaccctcagccccatctttggttccaaatgtccccaggccccatgaaccttaactcttctccctgcacactgaccctggtcttgtctcaaatttcctctttctggagctctgtgtatagtggaaagacaggctcagaaatgcccagcggggacttctttgagttgcagcaacatctttgaggggcacagaggcctgagtgatcacatctgacttggaagcctggggagggcttcacagaggaggtggcgtttgagaaggattttgacagagagtggggaggatgggcgttttgagctgaggtaagcctggagaaaggcccgaagggctggaggtgctaagtgtgttctgcagcctggcatgtgtgaaggatggggtggagatgagacaagagagacaggggctggatcatgaaggtccttgatggcctgtctgtggag

SEQ ID NO: 14008 - DNA, 409 bp, Homo sapiens
cttcctctctgggccgcgagcccctcttgtgattggtaagacctttccagctgtgacaggctgagcccaactcgactctgtgaaacgtaccccaccccccagcccttcttccagtccccctcttccatgaggagacccactctgctcccaccctctgaaaacctaaagcacagcccaaatcccccaccccagcagcatacctagggagctcctagtcctggtaaaacggcaggagtaggtgctggggatgctgagaaaggaacaggaatcctgtccaggcaggtcctacctctgcccatgtggctggccctcatgtctgggtcttctcactctactctcattactcctccgcgcctgtcaaacccctcattgttcgcagctgatgtcactcgcagttgtgagcggccgc

SEQ ID NO: 14009 - DNA, 326 bp, Homo sapiens
cagatgaacaagatttcatactgacaccaccatactctgttaaatagttaaaaatcctattttggcttttgtttgctcacttagatttgtacacccaaggtgatgaagagagcacagatagaatctagagacaaatagtttctggagtcaggaatcagatccagattctaacacgaggtgatgtgggaaaaagtcagttaaaatttctgagattcaatttactcatctataaaatcatcctcataataattgctccccccttcaaaggtttgttatgaggagcaagtggaaaaatgtctattaacgggctctgctgtcagtggatt

SEQ ID NO: 14010 - DNA, 1182 bp, Homo sapiens
ttttttcctgaggcggagtctcgctctgttgcccaggcgggggtgcagtggcacatctcggctcactgcaagctccgcctcccgggttcacgccattctcccgccgcaggagaatcgtttgaacccaggaggcagaggttgcagtgagttaagattgcatcactgtactccagcctggcaacagagcgagattccatctcaaaaaaagagaaaaaactttaaatttaaaaattaattagcacaatgctttatataattcaattgctactctttaagctaatgttacttcctgtaatcttacctacacatttctttatgaaatgttcagaaaaacttcttgtgattgccctgaatacctgaagtgctacccttgaactgcagtgtcccagttcctatcaatcaaatcttaatctaagtccatgtatgacagtctacacgtgtagggtcctcctagatgaaaacctgtgtctgctatcaagtcaggaagacattgaagtctaatttcaagatgaagcagtgcctctttggtatgaaacaaattagccagatgaaacaccattctttaatgttcagaaattaaagctcttgattctaaaatttatagaaaggtcacaccaagagcaataatggaatatcactaataaattatcacatccttattttaaaattacacctttgtagctaaatgctacccagctggtagaacaaagggaggatggtaactaaactaatatcattatttgagataaccaatcataagaaataaaacttcacttgactcatatttcatgcaaaaacaaaagtctcaagtctttggtcttggccaacatgcaaaggcgtgccacggggcggctctgtgaggacaccttgtgcgcctggtgccacgtggggcaggtccagctgagcccagactcgcaggccaggtgagctgcccatgccacttcctgccaatcgctggtttctgctctctgaggcctcccacccaattactgaccaggcccagacctgcccgaataggatcttctgagaacacccagagcagtgttatgccaagtcaactgctatccgaatcaaccccctataagcaccacaacgacagcgagcacaaggaaaacccagccggcgactaacaccaccacgtagcgctgggacaaccagaccaccgggaatacaagccagccc

SEQ ID NO: 14011 - DNA, 1015 bp, Homo sapiens
ttttttcctgaggcggagtctcgctctgttgcccaggcgggggtgcagtggcacatctcggctcactgcaagctccgcctcccgggttcacgccattctcccgccgcaggagaatcgtttgaacccaggaggcagaggttgcagtgagttaagattgcatcactgtactccagcctggcaacagagcgagattccatctcaaaaaaagagaaaaaactttaaatttaaaaattaattagcacaatgctttatataattcaattgctactctttaagctaatgttacttcctgtaatcttacctacacatttctttatgaaatgttcagaaaaacttcttgtgattgccctgaatacctgaagtgctacccttgaactgcagtgtcccagttcctatcaatcaaatcttaatctaagtccatgtatgacagtctacacgtgtagggtcctcctagatgaaaacctgtgtctgctatcaagtcaggaagacattgaagtctaatttcaagatgaagcagtgcctctttggtatgaaacaaattagccagatgaaacaccattctttaatgttcagaaattaaagctcttgattctaaaatttatagaaaggtcacaccaagagcaataatggaatatcactaataaattatcacatccttattttaaaattacacctttgtagctaaatgctacccagctggtagaacaaagggaggatggtaactaaactaatatcattatttgagataaccaatcataagaaataaaacttcacttgactcatatttcatgcaaaaacaaaagtctcaagtctttggtcttggccaacatgcaaaggcgtgccacggggcggctctgtgaggacaccttgtgcgcccgggggccccgggaggccagtcacactgggccccaatacccaggcaccagagcaggccaaaggcagacgggcacaacgcgggaacggcacacgaagcccacaccaatacggacaggccagactgccgaggatctctggc

SEQ ID NO: 14012 - DNA, 870 bp, Homo sapiens
tcaagtagtctgcctgccttggcctcccacagtgctgggattacagccgtgagccaccatgcctggccttttttttttctttaaactaaagacttaactgtttttttccgtatctcctcagccccatgttttagactattttaccccaaaattgtatttattaatttggctttcccatttgaaaaaacaaattgatcttagcatggtggttagcttgaggcaatctttagtgagtcagtataattttagctaaaacagttgtatctcatgtaaaagtatgattttctttaggttttttttttttaattgaaagtaactcatgaattctctttattatctcttctaagggcttgaggatatcatgttatccctggatgagatatccttcccaggcctaacattctgatttaacaacactttcactaaagccttttgccccacctttgttcctgtttattaatatatttagttatatgattaaaattgaactattttatcctagatggaaagtatcagatggaaattcgtttaggtcataattaaacttgtgtgccttagaaaacatctgtatttgaaaatcaaattggccaggcaccatggctcatgtctgtaatcccagcaccttgtggggccaaagtgggcaaattgcttgagctcagaagttcaagaacaaactgggcgggcaacatggtgaaatcccgtctctacaaaaaataacaagaattagccacatgtggtggtgtgcacctgtagtcccagcttcttaggaagctgagatgggaggattacttgagcccaggaggttgaggctgcagtgagccgtggttatgccactgcactccagcctgggcgatggtgagaccctgtttt

SEQ ID NO: 14013 - DNA, 387 bp, Homo sapiens
tccaaaacattcaaaaagtaaacccactgaagaataataacacaacaataaaaataatacacattttaaaatacaatataacaactatttacatagcattttcattgtattaggtattataagtaatctaaagatgatttaaaatacacgagtagaagtgtgtaggttatatgtaaatatgccattttccatcaggagcttgagcatccacatttgcctgtgaggatcttggaatcagtctccctgagaataccaacggacaactgtacaaagataatgctaacataataacagcatctctatttggattttgaatgttaaaaatatttgtaaaacagtgtattgggggtattgggatttttaatcaacaaaggtaaaatgaacatt

SEQ ID NO: 14014 - DNA, 471 bp, Homo sapiens
ccccaccaagattctgttgatgggaggaagggggatatgttgcctggttttaccttctagcgagattatgaacctctgtgtgttctcgtctgagccttaggctatctagacagaaaaccaaagtggagaatcatgaacatcacccagagtaagacagccactcagcgactatactagaggagagcggttgaatgtgacagggccgggctcacatactggccgtgggacctcgggcaaggtacacagcctctctgagcctcattttcctcacctgtgtaatgggctattacttaccttctctgtttgataagtcagttttaaggtgtcatatgcgaatgagctctttgtaaacaataggaagtactcaacccttttattatgaaataaatcactggatgtgtacactgttcctaaatagaatcatacctaatttcttttgctttctaaaattaataaatcagctgttattta

SEQ ID NO: 14015 - DNA, 265 bp, Homo sapiens
ataaattgtagatacataaattatgtgtaaaattcacatgaaaaactctctccacctcattttaccctttattccttctctttaaatctgttgaccaaaacaaatcactgttaacatttgttatttaggggtccagaaatgttttgtgtataaccataagcatgcatatatatacatatcaacagctacatctagatggtccacttactacagccccagaatggaaatttcttcctcaaagcaaacattagaggcatcttctggg

SEQ ID NO: 14016 - DNA, 525 bp, Homo sapiens
ttaatgactattaaatattaggacttaaaagaccttggaattaatttaatcccttagttttccattttgtgacatacatcatgtagctcaaattgttcatagttactagaatacgctaagtaaacagaatttaaaggctagagcttaaattgctgattatctcaagatatataaatggtgagaaatatactaatttcttctaaaagcatatcgcatttttaccatcttcctgtatcctctctgtacgtatagaatggaggaactatatactgtactgtgtttatagtacctttttttgtcttcaaactctgcctcccaggttcaagcgattctccagcctcagcctcccgagtagctggaattacaggcgcgtgccaccacgcccagctaatttttgtattcttggtagaaacagggttttgccatgttcgagaccagcctggctaacatggtgaagccccatctctactaaaaatacaaaaaattagccaggcatggggatgacagagtgagactccatctcac

SEQ ID NO: 14017 - DNA, 1470 bp, Homo sapiens
tctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgta

SEQ ID NO: 14018 - DNA, 1129 bp, Homo sapiens
ctgctagagtcttgaggataaaccgagggggggtaagaaaggaaagataatgaagagctccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgta

SEQ ID NO: 14019 - DNA, 1434 bp, Homo sapiens
tctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctcccttgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgta

SEQ ID NO: 14020 - DNA, 876 bp, Homo sapiens
tctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaaggacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgta

SEQ ID NO: 14021 - DNA, 6135 bp, Homo sapiens
ggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttcttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtca

SEQ ID NO: 14022 - DNA, 2696 bp, Homo sapiens
ggcacgaggccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatggtagcgaaggatctaacctgactcacatatcaaagaacggactgtcagtgtcactggcctcgatgttctcagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatggtgagaaagtctcactgtagcatgcagctgagcccttgcttttagggatacagggaggggggtggacctggggttcttgccacttagcttgaggaagttgaaatggccagtcagcactgggagaggaactggaaagggctgctgttccttagcctggagagcagccaaatcatcctgatctaaagaacctcgagtgaggggaggagctggtgctggctgtggtcctgggtagctccgggcaagaccgagtagactttcactcaagaagtgttggccaggcacggtggcttaggcctctcatcccagcaatttgggaggccgaggtgggcgggtcacctgaggtcaggagttcaagaccagcctgacgaacatgatgaaaccccatctctactaaaatacagaaattagccgggcatgatggcgggtgcctgtaatcccagctactcgggaggctgaggcaggagaattgcttgaatccaggaggcggaggttgcagtgagccgagatcatgccactgcactccagcctgagcgacaagagtggaaaaaaaaaaggcagttgtcatgatgtgagaggagagctctggattggaatcgagagggagtctaccctcggccgtcatttgttgttctcagtcattatgaccaaaataaatactttgtcccctcaaggcctcga

SEQ ID NO: 14023 - DNA, 6039 bp, Homo sapiens
ggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttcttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtca

SEQ ID NO: 14024 - DNA, 6637 bp, Homo sapiens
ggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttcttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtcagcctgccttgactgtcaagaaatggcatgtgtccactgtaaagcaggtatatctgaacattgagaaggtttctgtgttataatgtaaagcaaactggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccagtgtgtctaaaaccagcataaattccgtatttccaaaaacctaaccattagtcacccaggtttgaaaattaattgtcttcaacttcctctgtaagtggcacactgagctcatcacgcatcgtctcattcctactccctgtcatcaagttctgtggatgttttcctctaaaataaatctctcattacttttctgccactagcacacaaaaaaaagt

SEQ ID NO: 14025 - DNA, 5249 bp, Homo sapiens
ggcacgaggccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaatcctgcaatgataaggcgaagttgagaggccctttgccctactctggtcaaagcagtgaagtcagcacacccagctctctgtacatggaatatgaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttcttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtca

SEQ ID NO: 14026 - DNA, 4406 bp, Homo sapiens
tttacttgaaactttctaaagggaaagtttccatttctctctgttgaggtcatatcagatcccttatattgtgacactggaaggacaagaagacctctttctgccctgtttattcctttttgtttttaaacataacaggctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttcttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtca

SEQ ID NO: 14027 - DNA, 3062 bp, Homo sapiens
  misc_feature (15)..(15): n is a, c, g, or t
  misc_feature (30)..(30): n is a, c, g, or t
  misc_feature (38)..(38): n is a, c, g, or t
  misc_feature (58)..(58): n is a, c, g, or t
  misc_feature (65)..(65): n is a, c, g, or t
  misc_feature (68)..(68): n is a, c, g, or t
  misc_feature (89)..(89): n is a, c, g, or t
  misc_feature (97)..(97): n is a, c, g, or t
  misc_feature (102)..(102): n is a, c, g, or t
  misc_feature (132)..(132): n is a, c, g, or t
tcccgccgggattcntcgtggtggtcaaanaatttttnaatcctctctgggtgagtanttgtggnaantgccctaaattccaaatctangtattaangaatntatattaagtttgcgtgaggagaaaacctntgtgaagcgagggtaaattttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccgactccgttctctccccttcctgcagcagagctgggtccttccctggtggccgagtctctcttgccttagcttctttggtcaaagttggagaaaagcttcctgctattagtgctgttacagaacttgacggtttgtggatgtgagtgtgaatgtccctgtgttcttgggataacaagagcctttatgccaattatgcacttaactctgtgtagcctggtaatgtttatctgttcatttgataatgctgattttagtgtgctgcccccctccccccgttaatgtgtgttgatggtgaagtccttttgataatgctgattttggtgtgctgcctcccccttcccccccgttaatgtgtgtgttgacagtgaagtccttgggtggggccatgtgtgtgtttgtgatgttccttaagttgatgcagcttctaacctctgtgaaaacactggtcagagtggcttctccaagagctggcagctctgtgaactaaagcctgcatcatttttgttctgggattgaattctgcccatgggcatgtcttctcatagttgcttgctggtaggaaagaaatgggcgtgggtgctgccctggaagctgagcggaaagttgcctgtggttggtggaagctgatgagagcttgagctggcggtaagaaggagtctcccagggaagtgggagaggcattaaggtgatggccagggctgaggctccaccagcgtgagagggaacatgtgggaactggcccctgcccttgattcctctgcctcaaagttgggatctgaaagccatgtagggctagaagaccctgaggctgttctcccttctgttcatagtgagactcaaaaagccaagtcccagaagttctgaagggctgtgactagaagtgcccaggtccttcagggagctttaagaatgaccccacagaactcaagtttaactaggggttaggtcccagattcagacccaggagtttataaaaatgagctctacttccagttttggtttaaattacacatccaggccaggcacagtggctcacacctgtaatcccagcactttgggaggccagtgcgggcggatcatgaggtcaggagtttgagaccagcctggccaatgtggtgaaaccctgtctcttccaaaaatacaaaaattagctgggcgtggtggcacacgcctgtaatcccagctacttgggaggctgaggcaggagaatcgcttgaacctgggaggcagaggttgcagtgagccgagattgcgccaccgcactccagcctgggtgacagagtgagactccgtctcaaaaaacaaaaaggtgacacatccagctctttctccaggtcactgcgctggaggacagatgtgccgtcttgtcctgcctgtttcacatcagcataggatcaaaggatgacaatgctgacagcttctgaagccgaactcaacagtctcataggctcctcacttgtcacttatttttccctagctccctcaaccgcaccccatccctttagatcgtgcgtctgttttagtgactctgacacgatgccgtcctcaccttccaaatacccagttatttattcaagaggggggaagtgggtagaggatgggatgttttggaagcactttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtca

SEQ ID NO: 14028 - DNA, 4017 bp, Homo sapiens
ggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagctttcgggtcacctccagcagctcccagttcagctcacgtgattcggcacagctctctgactctggctctgctgatgaggttgatgaatttgaaatccaagatgctgacatcagaaggaacacagcctcaagcagcaaatccttcgtttcctcccagtccttctcccactgcttcctgcactccacgtctgctgaggcggtggccatggggctcctgaagcagtttgaggggatgcagcttccagccgcctcggagctggagtggcttgtcccggagcatgatgcccctcagaagctcctgcccattcctgactcactgcccatctcaccggatgacgggcagcacgctgacatctacaagctgcggattcgtgttcgtggcaacttggagtgggccccgccccggcctcagataatttttaatgttcatccagccccaacgaggaaaattgccgtggccaagcagaattaccgctgtgcaggatgtggcatccggactgaccctgattacatcaagcgactgcggtactgtgagtacctgggcaagtacttctgccagtgctgccacgagaatgcccagatggccatccccagccgggttctgcgcaagtgggacttcagcaagtactacgtcagcaacttctccaaggacctgctcattaagatctggaatgatcctctcttcaacgtgcaggacataaacagtgccctctataggaaggtcaagctgctcaatcaagtccggctgctgcgggtccagctgtgtcacatgaagaacatgttcaagacttgccgactggccaaggagcttctggattcctttgacacagtcccaggccacctgacagaggacctccacctgtactcactgaatgacctgactgcgaccaggaagggggagctggggccccggcttgctgagctcaccagggcaggggctacccatgtggagagatgcatgctctgccaagccaaaggcttcatctgtgagttctgtcagaatgaggatgacatcatctttccctttgagctccataagtgccggacctgtgaagagtgtaaagcgtgttaccataaagcctgcttcaagtctggaagctgtccgcgctgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttcttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgccatcctaaggtgaggacaggaacctcacccaccatcttcttagcgtgtccctgatgactctgtcctctgttagatggtcgttgtgcttctgagtaaaagtacaacccga

SEQ ID NO: 14029 - DNA, 2126 bp, Homo sapiens
ggccgggatagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggatgcggccggagggcgcgggaatggagctcggaggcggcgaggagcgcctgcctgaggagagcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggcgtgccgccgccagacggattactggcagttcgtgaaagacatccggtggctcagtccccactcagcccttcacgtggagaagttcatcagcgtgcacgagaacgaccagagcagtgctgatggtgccagtgaacgtgctgttgccgagctgtggctgcagcacagcctgcagtaccactgcctctcagcccagctccggcccctgctcggggatagacagtatatcagaaaattctacacagatgctgccttcctgctaagtgacgctcatgtcacggccatgctgcagtgcctggaagcagtggaacagaacaacccccgcctcctggctcagatcgatgcgtccatgtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcagagagaagatctacttcctttccactctctggccctccccggaaacctcaagaaagcagagggcacgtctcaccagcagaggatcaaaccatccaagcccccccagtttcagtctctgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccagaaggtggtcggtacctgtgctcaggggaaggcatgttccgaagaccatcagaaggacagtccctcatcagctacctctctgagcaagacttcggcagctgtgccgacctggaaaaggagaatgcccacttcagcatctcagagtccttaattgctgccatcgagctaatgaagtgcaacatgatgagccagtgcctagaggaggaggaagtggaagaggaagacagtgatagagagatccaggagctgaagcagaagatccgccttcggcgccagcaaatccgcaccaagaacctgctccccatgtaccaggaggctgagcacggaagtcagtggagcctgtggatgcttctgttcccacattttcccaacttcagcataaggcctggtgcccaaaccagtggttcctctgctgtcagatgtttctatgtagtcctactttttttctatcatgctaggaatactcatcctagagtcgctccgtttcctgcatcagaaatacctgccttccaggccaggcagagtggctcacgcctggaatcccagcactttgggaggccgaggcgggtggatcacttgaggccaggagtttgagacctgcctggccaacatggtgaaaccccagctctaaatatatatatgtatatatataaataaaggaatagctcccttcccaaatagct

SEQ ID NO: 14030 - DNA, 247 bp, Homo sapiens
agcacctacccaaggatgcaagttcctaaacgccatttcatgtttgggagcaaatggcaagttttgattccaggaacatatggtatagaatattagtttatttcctgctggaatactaagggcccccttttatcatcattattacacagatggtagcgaaggatctaacctgactcacatatcaaagaacggactgtcagtgtcactggcctcgatgttctcaggtagcctactttgcaagcgtgga

SEQ ID NO: 14031 - DNA, 490 bp, Homo sapiens
aagccagttgtcagtcagagtgtgggacaatctgaagccaggtgtcgagtcagagcataggacagtctggagccagttgtcagagcgtaggacagtctgctctgggtgcagcatgcaaggcttctagaaccccagggtttaaaggccctgggcttcccacactggattcctcttctcacatctccctcccactcctgcccccctctctttcttttcagctgctgcgggtccagctgtgtcacatgaagaacatgttcaagacttgccgactggccaaggagtaagtccttttggagctagagccctctggccacgttgctgtctccgaaagggacacatccccgcgcttggctcttgttatgtaacgaaggagagtagagagattttgcagaactgtaaagtggtaaacaggaggccacagcagtaactgtatctgtgtccttctctctggaaggggatctgtggtcattccatccaggacaggccacct

SEQ ID NO: 14032 - DNA, 383 bp, Homo sapiens
cttgtgatatttggggggagcccccaccacaaaaataatttctctctctgctaggtgatttcttccattttattattattttctttttatggtgatgttgaattgaggagagatgttcctgctacatttattaaaagttaaaagaaaatcccagcaccttgggaggccaagacatgtggatcacttgaggaaggccaggagttcgagaccagcctggccaacatagtgaaaccgtttctgtactaaaaatacaaaaaaaattaggctggcatggtggcgcatgcctgtagttcctagttccagctactcaggagtctgaggcacaaaaatcctttgaaccagaggaacaggtttcagtgagccaagaatgtgccacactgcac

SEQ ID NO: 14033 - DNA, 819 bp, Homo sapiens
gtcaagaaaacaaaaacaaaaacaaacacaaaaaaacctcttccatgttccagacatgacttcctatcaaaccaagatgcgctacaatcacaggagagcttcctttcccttgggcctgcagttttgctgggcccggaagacaagtcaagtttatctcaagcagtcccgctgacacagggttaaatgtttccatgttaccatgtgactaattcaaactcattctaattcctgctgttgctgcttttgatcggttacaaattttcaaggctgtgttaacagcacctcgtggaatcctttttagactcaacttggcttgagttattagtgaaggtttcatcaataacttctaattcaaacatgctaactaaatgactcaaactagcttttctggcctaacgtggatacaatatctcattagtggaaagcctgaaaaatttcaattcagtaagaggggataatccaatttgtactctcttaagaaaattgcttctcaaaagtcacggtggaataatgacctggaatgaagaaaacagaaagaaagttgaagaggcttggaaggaaatactaattgaactgtgaaggcttttaattcaaagctattgtttggcattcatttctgtaaatgtattaactaatatgctgatacctgactcataaacagacaagtacttgtcatgccactgtctttttttttttttttttttgagacagagtctcactctagcctcagtgacgtgagtgaaattccatctcaaaaataaaaataagaaaactccaatgaactaaatgaactaaggaacaatttcctgttctagccac

SEQ ID NO: 14034 - DNA, 542 bp, Homo sapiens
tactcgggaggctgaggcaggagaatcgcttgaacctgggaggtggaggttgcagtgagctgagacagtgccactgcactctagcctcagtgacgtgagtgaaattccatctcaaaaataaaaataagaaaactccaatgaactaaatgaactaaggaacaatttcctgttctagccacaaaaaaaagaaagaaaatacataggttcctgaatttagaatattaaaatatgctgaatttaaatgacatctgattttttacccactagctaagagctttctagggggaaaatgctgaatatgtggaaaagtttaattactctatgaattagaagaaattttcttgtaataagaccattcatggaaatggtgcctcaagggccctgtgaactctacaacccaagatgtaaaatttatatctcaccatcattttctctcccaagacagactgtccctgaagtgttgtctactgttgtggaggcaatcactgtcattcccaggcactgagcctcgaaactgcagagtcaaaggtgacctccttttc

SEQ ID NO: 14035 - DNA, 279 bp, Homo sapiens
gtcttggggggcctgacacagcctgactcacaggccaaccaccagctcagatctaacctggtgaccaggtacctctgggaactgggttaaagctagttataaaagacaggaactgtgtagaagctggattaattaacgcttagatctctgtgtcctgacagtggggaggttaaaaatagcaaaattctcattctccatatggggaatttaataggtgatgcttgaaaaacagttctaagtaaacaatataagcatgttacttggaaatatgaacataaa

SEQ ID NO: 14036 - DNA, 343 bp, Homo sapiens
gagatttcatctcaaaaaaaaaaaaagaaagcttgtaaagcgattccctagaattaaaccatgtagtgcgtatatattaacataagtattttgaaaaaaggctgaaatatctctgtgtgagcagatagcccaaattgaatgctaacaaccgtatagcaaggagacatgttgaaagagatcatataacttaattataaactattaagtgtagctctttaatttaaaacttgtaaccagccttcctactttccttaaataaatacaccccatcatcaagaaacttgaacacccttggtttttctctctttactttcactgggttaaggaagttctagttttacct

SEQ ID NO: 14037 - DNA, 400 bp, Homo sapiens
aaaatatgatatgttccatggtgcctttgaggatccaccaaatacagtactccaagtgtgtgtgagtggggtcttcataaacttagtccaccgccaagctaattaagttttctgcataagataactatttaggggcagtcactctgtgattctccccatgctcatgttaaataaatttgtatgccttttctcttattaaaaaactgtttagtcaacttcacaaactttccatatgtagatatatatatatatatatatatatatatacacacacacatgcacatatatatacacatatatagatatatacacacatatatatacacacacatatatgtacacacacacacatatatatataatatacacacacacacacatatatatatgtagtacgacc

SEQ ID NO: 14038 - DNA, 224 bp, Homo sapiens
aaataacttgggtaattgccatttggccctgtgaaacttaatgttagagctaaactttctgcctcctggaaacatgctaggaaaatttcattccttagattttgctaatgttactgtttttatgatagtaagtatgaggaagtgaaataaaacttctctgtcctttatgttgtgcttgggatccatgtggaagttctgaaatgtaccagctccttagtggggaa

SEQ ID NO: 14039 - DNA, 504 bp, Homo sapiens
ggggtgtttcatccctagcaagtgcctcctgtggacttttaagatgaaaaacttctgcctaactcttcaggaagcctagcgtagttgtaaaaatacttcagaaagcacttctggttttagctcagacacgtagagtttgaaagttatcctatccttaccacaagaaaaagctgggcaaactcaaaagcattggcctttcttggtcccattagagagctgagtgtgcaggtcaaactgccatcccaaaatctagagagaggtgagtccagagagtgagcaagatctaattgcctggagcagaagccacgggagccatagctagtaggaaaacttaaatggtaattttgatgaactgctggaggttgagtgtggactagcatgggagggagcaactccccctcacccccaacgctttcctgggttttaccctacttggttctattggtgaagagctgaggaagaccctctggtgactctggcaggggaaagggagaatcatctttg

SEQ ID NO: 14040 - DNA, 485 bp, Homo sapiens
ctgtgtgtcagagtcctttttggaagcaatgcctatcctcctatgtgagtaatgcatgtaaagcagcccagccctaaaatggtgctggccagggagctgatggccatcgacaggagacctctattaccagttaggccttgggggcttcagggaatatccaggcctctaagctataaagaaaaacaggaccttgaatgaagccagaggactgcttctctctctgtgaagcgcctcttccatttaaacatccaacacatgagattcaggtatgggaaaccacagaggaagagcaggtaataggtaaaataatatttatttcttcttccagtgctttctggcttcaaaatttcttctattcataggtagagttgcaatgaagctggtaaaaatgagcccccatgggaaaatccaataggaagtattgccaagctatgcttcaaaatactatctgtaaaatttctcaaaactctagagtttgagaccag

SEQ ID NO: 14041 - DNA, 331 bp, Homo sapiens
acagattgacacccagattgtgttacataatagaaatgtgtcctaatttgttgtgaattttgtgtgaaaatacttcctaactcatttttgtaaagtgtctttagacttgacagataatacaggcaccagtgccttgaaaatgtcactgtgaagaactgttttcttcagacttttcatctaccagaagatttactcttctaatcatgcaattgcacaatagaaaaatctgctacaggaccatgacatgaacctgggaggcggagcttgcagtgagtcgagatcacgccactgcactccagcctgggtgacagagcgagactccgtctcaaga

SEQ ID NO: 14042 - DNA, 424 bp, Homo sapiens
aagctagactcagcactcagagcctatttttgtcttgatggcacctactgaaccagctaaacctgggcttatggtttcattgccttcgcagacatagaggataggagactaagctcagtctatgaggagactccaccgagtgtctgtgcacccctccccacccctactcctgccaactccgaggaaactggactgtcacaaatgttggcactaagttgaagtggtggtgcaggtttgggggttgttattctttgacattttatagttgcaacctagcctttatgtttccatatctaaatcacactttttgggttagcccaaaagtatcttaaaatttgactatggttcaaagtaattctggccactagtaactccaggcacttgcagaagcaaatgcacatcacagtaaaagatcacacaactc

SEQ ID NO: 14043 - DNA, 814 bp, Homo sapiens
accagcacagatgttatcaggcatcttccgacctggggaaggggacctgagtgtttgcacctgttttgttatccatgggagtatctatcagcacacccatcccagggctgttagaatgaaatgaggaaatgcttgtaaggcactcagcactttcttaacacattatacatccccagtcactgactatttgttatttattaatgaagcatgtggggaggctgtgaccttgtgcttggccttcggcagtgctgctgagagagctgagcttcatctgaactggaccacatgggcttgcatctgatcagcctgggataggtggggaataggcttcggagagcatgcaggtggctgaggttgctttcaaagctccacagtatcctgcccatcccacaactccaatagccagttgaggttatggtgtctgagactcactgggcagggtagacagagtgtctgtgcccttctgtgacttgcttctattgtgtaaaactgccttgcagaaggttctttggagagccaggttctaaaagggattctttcccacctgtgaaatttggctctgtcctttgtagggctctgcagctctttttgccctgtggcatatcaactcaagatgtcaggaagttgtaaatgcagaaccagagggtaatgacatgtgttgctttcaaaacacacagctaagctctatttttaaaacccccaattttaagtgatgtttttcagtgtgtgtactcttaagcaagagtgtaaaaatcctctttgtaaccaagcattgagcactgggaaatttcttggatgctttttggagattaat

SEQ ID NO: 14044 - DNA, 1524 bp, Homo sapiens
gatatgtaaagtttttgtcaacctcccaatatctagcatacttttcagctaaacccagtacgcagcgtccattcttcctatttcaatctataccatataactcagaataattttcataatatttacttttcccatgttacacatagtacttttatattcagaatactccagtgatgtctctcttccttaagggtgacttctatattcatgagcctagcatacagggctctctatagtagacctatttctgaaacgtcatctctagtctctagagtagatctctctcctaaccccacaaattgtctaaacaataaccttcctttgaagccaaggtcaaaagacacattctttaatgggctgaaacttctatatttgtttcttaggcgttgattcctaaatcaacatgagggaaactatggacagtcatttaggcactctcaaaatataagcggaccctctttattctttgttataaccctaacatgtgaactgagttcttcttacagtaattgaaaacacattttacatcttgcttccttcaacattgattctgatttcaggttactatttgcacacgttgtttttttttcccccattttactcaacctgtgtgcattattcaattttattttgacatttcctgattttggcatcactgctaattcttagtcagtccatctgttgttgggcctctgatagtgggtgtccaaccctgtgccatgtcctttcttacatgaggaactcagtgagctagtgggaagaacctcacttgctttctgatgtttgattttctacccaggctgtgcacgttcatgaaaacaattcaggagctggtgcttgagtgctgccaatttttgcattttttttaaggaaatagacacaagaatctgtgatatttcaaaactaaaaagatgctttgaagaactgttgtgttaaggacaagatttttattcttggcttttgactatgcaaaaaacatatgttctttaggatagaattaaaagataacattctaggaccttttctaagaacgtgtaatgttgtaggaagaaaacaaactttaaaaaagaaataaatttgtaatgtagtaaaatactagtctattatacagcctaaagaaactgaaaaataatggcctatatgtcatttagcctaccttcaaaatggtttatttaaggataatacatgttacatttatttggccttgttttcacaataaaaagttgtaatgataatttgttttagattatatgccatctgtttatatcgggacacagtatctttttaacacaactcattgataattttttattatcaaaatgtgtgttaatttgaaacaaatgctatcttatttcagagatacaaagcattatgttttatctacatcacatagaaatagaagaaaatatatggaacttgggagagcatatgtgtacagtaaagaaaagaaatctcatgtagtggtcagattccctcccactctaggaggctgactggtcactacaaaatgtgactaaaaaaaaa

SEQ ID NO: 14045 - DNA, 378 bp, Homo sapiens
tcttaatgttgttctgagctagagaatctaggagtggccaacccggagatttgttccttgtttgtgaggagtatctgagcccccaagcccgtctcatgggacatgggctgtacagggaactgaggccctgagttttgggttaaaaaaaggttcccaggtagaggtccttgggggaaggttaagtgaaaatgctatataaactgcatgctgtttataagtggtgatggttttcctgccccacctgggccgtgggctgtgttgttcagccgctgccactgaaccatctgtttctgtacgaaaagcagttctcctgtccagcctgccgcctctggactgttcccctgtatgtaagcccctaataaagcccacatcctgttt

SEQ ID NO: 14046 - DNA, 467 bp, Homo sapiens
tcttaatgttgttctgagctagagaatctaggagtggccaacccggagatttgttccttgtttgtgaggagtatctgagcccccaagcccgtctcatgggacatgggctgtacagggaactgaggccctgagttttgggttaaaaaaaggttcccaggtagaggtccttgggggaaggttaagtgaaaatgctatataaactgcatgctgtttataagtggtgatggttttcctgccccacctgggccgtgggctgtgttgttcagccgctgccactgaaccatctgtttctgtacgaaaagcagttctcctgtccagcctgccgcctctggactgttcccctgtatgtaagcccctaataaagcccacatcctgtttgctggctctgtgggtctcttctcaggccccttgaacctggtgcctcccctactgaggttaataggggtttggcacaacacagccataga

SEQ ID NO: 14047 - DNA, 2037 bp, Homo sapiens
  misc_feature (1837)..(1837): n is a, c, g, or t
attgtgtagctatacctagcaggaataaatactaagtctgtgtcagtattcttccccttggtttcagttatctattgctgtgtaaaaaaccatcccaactttgttgcttgaagcacccaggattcattgtttctcataagaattttctgctggtctcatgcggacttgctcgtgtcctagctgggatggctggattgttcatcttgcagttggtgctggacaatggtgggctctctctcagtggctttcatgcacaaggaggctcacacaggcttcttgatacagcagcctcagagcatcagaagggcaagagtggatgctgtctggtctttgaagtctcactcagaagtcacctgttgtcacttctgtgttctattagtgcaactgagtcctgaggcttgcccaggtttgcactgaggaaatcgattccacctcttgctgagaggagcagcaaagaatttatcgccacttttaacccactacaacctcaatttcaactgattgtctctaatgacttcttctgtaagcatccaaaacatcccttgattgaaactatctcaaggtgacctatcttccttcaacaatattttgtggttcgaaactatgtcattaagagagtgactttgaaaacctatataaggacccagatgtgaggtgactgcctagtctgaggaataatgactttaagttatatttgtagagaggtggtaaagccagcgaagcagacccatggagaaatgcaaatctgtcatcagccttgaaggatgggacaaatttggtggtgccctggttaaggaggaacagcactgtgtcttgctggcaaagcctaggagactaatttgtaaaattaacatttctttgagaatatgctttgttactagaaagcagtttgatcaatgtactcttgtataagcaactagattaaggaacaaaagagacaccttaaagaaacacagtgagccttcagaggaggagagccttcatatcactgtaattagcaaacgtctcttatgcatcagttgggctgccatgaggctgtaattaccaggtcttagagtttgcctctacctacatcattgtataaaatgaaaaccagatgaaacaatcaaatgttctatgcaggagaaaaatggatgcaaaacaaggcttgcaaaactcttaagtgctctatattgctaaaggttaactgcattgcctgacataaggaaaaaccaggaaactactctaaatgaggagtagcatcaagaaaccacaaaagaaagagctcgacataataaatacattattaaaatgcatagtatacagtgtaaaaggcagtctgcaatttttgaattatgtgtcctataaaagtacatcaggtaaatatgtgtaattggagtccctggtgctctggcaaagctcattttgctgaccttcagaaaactacactgacttttttaggagtattattttgatttgaaaaagctcttctttgccagtaaggaaaagtacagtatttacagaaaatgagacaaccacagtgtacttaaagtgtatgtagtgcatgcatgttctctgcaagaaaattaaaagtctctgtttttcattcagaagtaattagagaatgtcttttgtggctgctggaaaacagatgcaagactcctagaagtctgaagtgtaaaattaaagtagaatgtatcattgggtgtcctaatcttcaggtaatggcccaggcctgggaaaagtgaacagactttgtgttcccagttgtaaatgtgctccatggagtctatgatcatgctcactcaagatgtgacaaagcataaagagtcattttggtccagaaatccctgttggnacattaaactgggtgctgatattgactatgatacctggaaaaaaggcctcccatcatttcttaaagaagataacagttgtaccaggcacaacggttcactcctgtaatcccagcacttcagaaagccgaggcgggcggatcatttgagatcaggaggtcgagaccagcctggccgacacagtgaaaccccgtctttactt

SEQ ID NO: 14048 - DNA, 494 bp, Homo sapiens
ttacattcccatggcttcttataatcttttaccaaaaacatattttactttctttacacaccttgcatgtcttttttatataaacatcacacgcataacacatatataactacacagatagacaaaacgtgcagtagttgtaagatttttcatttgccaatctgctaattggattactggcctcagggtggagctcttcacgcaacagggccaggaaaacatgcagtttctatgacttaataagcagatatagctggaagacaagaatagattttgagagggatctatcatagcacttttaattcttggggttctgaggaaaacagggtttttctcccaaaatagggtccttggtgacttttctgtttttcccaaagagtcccatgctctcagaagtgatcttagggcctctcatgtgtgcattaagagtggcaagacaaaatggagaaaaataactcagtcaactgtgaagagaattaaaaaaagcttctttc

SEQ ID NO: 14049 - DNA, 379 bp, Homo sapiens
agaagtgttctgtttgaatagagaaaccgtttgtttttctcagtgtgtgtgtgtgtatgtatgcgtgtgtgtatgtatctgtgtggctgtatgtacatatgtgtgtgtgcatatagagacatatatatgtatatatgtgcatatataatttatatatttatatatagtacttaagaagcaatctaatggcacatcacctttatgaaaaatttttaagaactttaaggatacaaaggaatatttaagcaaatgacaggatattacatgttcaaaaatatttgatgtcagattttctccaagtaatctatggaatctacacaaactcagtcaaaattcttatgaagatataaagatccacagacagcaaaataagtttgag

SEQ ID NO: 14050 - DNA, 485 bp, Homo sapiens
ataacattttactttaaggctaaactgctttttggatacaacaacaacaaaaatacagctatttttatcacatgagaatatggaaaagggtaatttcagtgatataggaaatgagttgtcctcattatccagtggtgagttgacttctcaataaaataccagctctacttatcttcattgttattattatattttcaaagactattccaagccaggcttcgtggctcatgcccatagtctcagtacggagcagacgaatcacttgagcccaggtgtttgagatcagcttgggcaacatggctaaatccttttctacaaataatacaaaaattagctgggcatggtggaccacacctgtagtcccatctacttggaaggctacagtgggaggatcacctgagtctgagaggttaaggctgcagtaagcagtgatcacaccactgcacacaagcctgggtgactgacactctgtttcaaaaaaaaaa

SEQ ID NO: 14051 - DNA, 547 bp, Homo sapiens
tggaagaattcagaaaaaactgctaacaatgacttccccttttgagggtacctggagacagacagggattattcaccctgaaaaactacttgaatggttaccacgtgcataaaaatgtttttaatgttttaaaaacatctgtgaaataatggtcaccataactaagttttttagcaaaaaattagaaataaatatgtttttcctttgggaaggattggtataaatttcagcccatccatactctagaatcctcttcagatattaaaatatttgaaaaattaaatgtgggccaggtgtggtggctcacacctgtaatcccagcattttgggaggccgaggtgggggcatcacttgagcccagttgttcaagacaagcctggccaacataacaaggcctcatctctacaaaaaaatagaaaaaaatagcctgtagccctagctactcaggaggtgggaggatcacatgtgcccaggagtttgaggctgtagtgagtcgtgatcgcactactgcactccagcgtgggtgacagagcaagatcctagctca

SEQ ID NO: 14052 - DNA, 443 bp, Homo sapiens
gtaccaggagtctgttttatgacttcagcctaccctggtcaccagcagattgagtgcaataaatttgggggcagtgaaaagcattttatattgtgataagtaaagatgacttcaaagccagcttgtactagtgtatctcaaaagccttgaaatatgtatttgtgttaatttagcaattcagccccaggacaaagtatgcaaagctgttacgtacaagcatgtttattataatgttatttgtgatagtcaaaaattggagataatctaaatgtgattagttaaataaattataatctacttgatggcatatcaggcagccattaaaatgacattttaggtgtgtactactacatattaaaaataatattagaatattctgtgtatagaatgattcattaaaaaatctatgcataaataaaaatttacaaagctgtccaacacaa

SEQ ID NO: 14053 - DNA, 488 bp, Homo sapiens
gaccacaaatgagtgttattatcccctcgtaaaagcaggcaaagtatatgtgctggcccatgagcccagctccgacgcacaggcttaagtgctacctgggtctcctgtcatctcgacacatgtataatctgggccctgttttcctgcttgcctaattcaagcctttttggcctgatttaggagcatggcagattctggttattaaaaagtcatgctatgactttaattgctaatactttttaaatgcaccatggaatcatggaatgtctgagctgaaaggagccttcagacgtcgtctcattcaaccccctcattttacagataggcatcccctgtcgccagaggggatgtgactgggcaaaggtcacacagcaaaccagcaaccgagcccagggatcctgattccaagattggagtgcctttttttctccaaaaaaacacataacatataataaatgaaagcagtctgtatttattcctgtaaaatt

SEQ ID NO: 14054 - DNA, 537 bp, Homo sapiens
cgggctgcaggaattcggcacgagtcaggttatatagctgtgggtcaccaagtttaaaatggcacaaattagaagacctggattcttagtttcccttttgctgctgaatagctggatgaccttggacaaatcacataatttcttaaggcctcagctttctcactttaaaaaaaaaaggataggttctgatgtctttaagttcctttcagttctggagtcttaacaagcagcctaatcagcttgtgatcatttaagaactgtagagtgccaaattaatacattttatttatttattttggttctctgtttatcttacacaataatgaatacattttaaaactgggttccagctgggcgcagtggttcatgcctgtaatcctaacactttgggagaccgaggtgggtggatcacttgagcccaggaggctgaggtgggaggattgcctgagccccagggaggtggaagcctcagtaagccgtgatcgtgccactccactccagcctgggcaacagagggagaccctgtctcaaaaaaaa

SEQ ID NO: 14055 - DNA, 535 bp, Homo sapiens
ggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggatttgaaagacaattaacccaggagaatactgacttatgcctctcaccaccccttctcacctctctctcttctccgttgaagctttggggacagcttttctgccatggagaacaatgcttaggagacttagagaaatagccaggtctatgttttgttttgt

SEQ ID NO: 14056 - DNA, 470 bp, Homo sapiens
actgtgaatgaaagctggaatgccttagcaaccccatcagataagctgtttttctggaattccaaatctacgtatatcaaatcaccaccattctttgaaaacctggtatggctttttattttttaacaaaatgaattctttgaagggtttctttcctaataatatctactttattaccccatgctcttgctttgactacccattttattaaaccctttgcaaacccaagcagatactgctggggaaagttttgggaggctgggatatttggctgccgtgggtctatagtttctctatgcaggggttctgcgtggatgtacacagccaccctagtaatcacctggacttaaacctagtagagtctgagggactgtcccaggagaccatccccagagcccaccatagtgaaccttatacccataaaaaccagggacattgtccctgaaactgatgatctagaagttggtgct

SEQ ID NO: 14057 - DNA, 420 bp, Homo sapiens
ccctgtttgtggctccatctgatttgcctaccctaattcttccctttgcttccattttctcacttatttttaatttagctctttatcttatatgaagctttataggctaccctactaacaaataaaacattcttttttagacttccttcttatttttctaaccagatttgaaagacaattaacccaggagaatactgacttatgcctctcaccaccccttctcacctctctctcttctccgttgaagctttggggacagcttttctgccatggagaacaatgcttaggagacttagagaaatagccaggtctatgttttgttttgttttgtttttttcttttcttggtgtaagctaaggttaatctttgcttgcttcactaagccagctcctttcttgcttgccttcttagcctaactcc

SEQ ID NO: 14058 - DNA, 462 bp, Homo sapiens
atcagtccctgttattccaataggcattggcaacatggacatgtatcaggaaacttccagccatggggcctgggttgtttcaagaaaagttgttttgaccaaaggcgaaccaaatttctgtctattctaggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcaaaaaaaa

SEQ ID NO: 14059 - DNA, 2080 bp, Homo sapiens
ttgttcccgtgctcttctcatgatagtgagtaagtctcataagaactgatggttttcaaatggggagtttccctgcacaagctttcttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcaaaaaaaa

SEQ ID NO: 14060 - DNA, 2108 bp, Homo sapiens
ttgttcccgtgctcttctcatgatagtgagtaagtctcataagaactgatggttttcaaatggggagtttccctgcacaagctttcttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagtactgggagatgatggcacctcggctgcggcccatggtgcggctgggcatgctggcccggatgcggagtgtggccgtgctctgggtgcactcggccgcccgagtgtctgctgctacttccacatgaatggagccccaa

SEQ ID NO: 14061 - DNA, 1289 bp, Homo sapiens
ttgttcccgtgctcttctcatgatagtgagtaagtctcataagaactgatggttttcaaatggggagtttccctgcacaagctttcttgtctgccactatgtgagatatacctttcaccttctgccgtgattgtgaggcctcctcagccacgtggaactagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcaaaaaaaa

SEQ ID NO: 14062 - DNA, 1349 bp, Homo sapiens
cggccagcgcagaggacgcaggcagaaggaggaagggctggccggggctcccgagcactcactgctcaagcctcgccgccgcctccgccgctgcggggtgcgcgtccatctggttggggctcctcatcccaacaccctccccaacggcccgccgcgcagccgcccgcgggcgagtctgtagcctgatcctgcgcggacccgccagaggcacaccaggagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcaaaaaaaa

SEQ ID NO: 14063 - DNA, 2005 bp, Homo sapiens
ttgttcccgtgctcttctcatgatagtgagtaagtctcataagaactgatggttttcaaatggggagtttccctgcacaagctttcttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctgctgcacccatttcactgaatcttaaatgatgctttcaagacagaaggaagaacagtacacctgagatgaccccaaaggtgggccttcttttgagaaaatttcaaatgcaaaattccagatttacagatgaaactgtcagtaagacaattcatgggttttcctagtggctttaagctattaaaacttgcaaaactttggct

SEQ ID NO: 14064 - DNA, 1509 bp, Homo sapiens
ttgttcccgtgctcttctcatgatagtgagtaagtctcataagaactgatggttttcaaatggggagtttccctgcacaagctttcttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtatgtattatatt

SEQ ID NO: 14065 - DNA, 430 bp, Homo sapiens
tgttatcattgttgtcgtcactattattatttcagaccttggtttctccccactctttcatgaagcccttatctaaccactccaggtcaaaatcatctctcttttctttgaattaacttacttttcctatcactgatttgatgactaggatttattgccttaagctttacatcattcctttccgattttatttccccatctcaggtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaa

SEQ ID NO: 14066 - DNA, 436 bp, Homo sapiens
atataaattagatccctgctgtactctcataatatatttgaatcacttgtcacatatcatgacatatattacctgcatagtcagccgactaatgtctctctttcccacaaactatgtgttcattaaaaacaaggaccaggtttgggggttgtggtgttgtgttttgtactgtttttttcttgccattctattctaagcattcattccaaggacataataacattttgtaaacactgttcaatcaatcaataaataaaaacaaaaaatatactttatgaaaaatttcaagctacttttaaaatactacataaaaggccaggcatagcggctcatgactgtaaccccagcgctttgggagggcaaggggggcttggatcacttgagtctgggagttcaagaccagcctggacaacacagtgagaccacatctctatca

SEQ ID NO: 14067 - DNA, 332 bp, Homo sapiens
ctaccaacacatgaactttggggcacacatccaaacgataacacattaacagtcaattaattgccttatcacaaggatgccaagacaattcaactgggagaaagaatagtcttttcaatagatggtactggaacaactggatagccacatgcagagaatcacacggaagccctacctcattccataaacaaaacattaatgccaaatccatcaaaggcctaaatataagagctaaaactatacaactcttagaggaaagtgtaggtgtaactcttcaataccttgaaattaggcagtgacttcttagatatgacacctaaagcacaagcaac

SEQ ID NO: 14068 - DNA, 172 bp, Homo sapiens
gaggaaggggactcacaggacagcgtttgtgggggtggagaggtttctttattagccaaaagtaggtcattcctgagtcagaggactattccaattaaaccgagagtaacggagaaggaaaggacattcctttgagaacaatcagatcggaaaacaaactggtttgttatgt

SEQ ID NO: 14069 - DNA, 397 bp, Homo sapiens
cattgcaatgaatcttcttagaatataatcctcaattttgagttatctataccttagagaaatttttacaactacattgcagagaaaggagctaatcaccagcatacacggtgtcaagggtagagatcccgttagagactgcctgagtttcagtcctatctcttttgcccagtttctcccttctgtaaagtagtcatgataacagagttcacctcataggtttgtttgttatgcaaattcagtgatttaacatttatgaaacacttagaacagacttggcacatgcttagcactacatggttggctgttaataagcaaaagcaagcaaaccactcctttgtggggtagaaacatatttcaacatagagaggaatatgttgtttttagcaaaaaaaaa

SEQ ID NO: 14070 - DNA, 371 bp, Homo sapiens
gcactttagtttgtagtggtgatttatttttcatcttagttatattaatttttagttcaataattttcattttgttgtttttttcttttttcactcatgatatactctaacttttcaactatcgagacattttccttatttatttaaatataggttttattaattgttgaaaccttaataatagcttcttaaaattctttttctactaaatctgacatcaggcacactcagtcaaattctattgacttcctttcttctgtatatggttcatactcatctttttttaaatttttttgcatgactactcatttttggttgaaagataaatattgaagtctatatatcttagtgatttggatgctcttatgttc

SEQ ID NO: 14071 - DNA, 448 bp, Homo sapiens
tctagacacaagatctcactctgtcacccaggctggggtgcagtggtgcaatctccactcaatgcaacctccccctcctgggctcaagtgatcctgctacctcagcttccaaagtagctgggaccacaggtgtgcaccgccacactcggctaattttttttgtatttttgttggtagagacggggttttcatgttggcaaggctggtctcaaactcctggactcaagtgatccctcctgccttagcctcccaaagtgttgggattacaggcatgagccaccacaccaggcaatctggcttatttatttagacttttcactccagaattttaggcaattctaacaaactcaggtgagaagcaacacattagaagcaggtaccctgaccgcatgaagatgtgatggagaatataccactattaatagagacaaacacaattaaaagcaga

SEQ ID NO: 14072 - DNA, 463 bp, Homo sapiens
tgttctttttaaaaagacacaaaaacattttagctaaattcagaagtttggtcctttaaaaagaacaaaaaggtgtctgctaaaaatatgttggaaatactcagtaaagcagaagctccagaaacactgtgggcataaaactctctcctacatattcagagattgttactgcacctccattccctgaaacagaaatcctctgtgatctggtagcaaaaggcagctgataatttatacacacaccacgcctgtgtgtgtgtgacccaaaggagagctggtctccactcgagagctgttttcagtgaatgagccctggaataggattcaagagttttagactctaccacacctttcaaagatatatactgaagcatttactggtgaaatatgtcaagaatttgtctagatccagtgagagggaatgagggagagtgagtgtggatataaatgaactaagattagc

SEQ ID NO: 14073 - DNA, 249 bp, Homo sapiens
tttattttctttgtatgactaaagcctcggggttagcagctatattgtcagcgaggcaatggtgtgggttttgtgatcagtgggacaaaagaaggaaaaagggaaaggatgtgaaggagaagctctgtccagttcctgttctgtttccctgggagctggacagacattcacagctgggtcttggtgttctcttgtcaaacaaaagtaatttccaggacaccaacatcacacaagaccattccgtgacca

SEQ ID NO: 14074 - DNA, 588 bp, Homo sapiens
attgtccatccagacaatgtgtttgactgcctaccaccttcaagacattgcattaggaaccagggatttggcgtgaccggcaaaaatagctaacactttcatagcatttgcaatttgccgagtgatgttttcagtgttttgcatatattaacccactgaagccttacaaacctctgagggaaactgttgttattttacagaggagagaattgagacacagaggttaaataacttactgtattagcctgctctgacaggcataatgaaacatcacagactgggtgacttaaaccaggggtccctaatgcccctggccacagacccataccagtccctggccttttaggaaccaggccccacagcaagaggtgagtggcaggcgagcaagcattactgcctgagctccacctcctgtcatatcagtggcctcataagattctcacaggagcacaaaccctattgtgaattgcatatgcaaggatctaggttgcatgctccttatgagaatctaatgcctgatgatctgaggtggaacagtttcatcctgaaaccatccaaccccgcccctcccacccccatccattaaaa

SEQ ID NO: 14075 - DNA, 437 bp, Homo sapiens
gttggtaccatcaacaaagcattggctatggatggtagaccagcaacatgagtataacctactgaagtgccaatcagaaaacctgctgagaaagtgaaagattaaactgtcagaatagagggaaggagaaagatgaagagtagtgtgagcatacaacatggaaaggcatactaatggcttcttgaatcattcattactccaatgagtgggattcaagccacgtttcgactgcgagttggtgtaatacattcctttagttaaaataattttttaatcaggtctattctgggagcttaaaaatctccatcataaacttctccagattttgtaaaaaatgctcagcttgaatcatcagagaaaaatgagcatcctgcctagtcaccaagaaattaaacttgaaatggtgtaagcagcttgggaagtaatttgactgattc

SEQ ID NO: 14076 - DNA, 804 bp, Homo sapiens
cttcagaggtgtttatttttcttttcttaaagtgctgaaaaactatttaattttaaaataagagtgctgttgcattgttccttaatacagaagtattgttgaaagtgcaacctctcaggaaagatgagcaaacttgttttttgtgggtagttctttgctgcttaggattcctgtaaatttacaagatactattggcttatgtgtttttattgtgaattactaaaatattaggccataaaaatcaaactttgtggtgccctgatagtgtttttgaacctctccatatcttttgctagcttaaggaaagtgtgaaggactttgaaaatatacctggcctagacttagaacttactgtgtctggccttcccaattttttcagtaggttcagaatacttctctttggtttgaattataattttgtttcttgtggttccaaaagttatctgtaatagcctcgttcttgtcattgcctcattcttaagaagttgctttttttgcttttgaatatttgtgggtgtttgacacagtgtatgcttaagacagatgaaaaaaatactaataatagtgttcatgtgagcaagttcattctgaaaaaggaaatgcttagaagtccttggtgttcttctttacacttgatactaaaaatacaaaaattagctgggcgtagtagcgcatgcctgtaatcccaactacttgggaggtggaggcaggaaaatcacttgaacctgggaggtagaggttacagtgagctgaggtcgtaccactgcactccagccctgggtgacagagggagactcagtatca

SEQ ID NO: 14077 - DNA, 350 bp, Homo sapiens
cgcggcggtgccccgcaaggcagaagtcccatgtgcagccgcagaaggcgggcggcgggagcagtccccgctgctgcacctcgacctcttcaacttcgactgcccagaggcggagggcagccgctacgtgctgaccagcccccgctcgctagaggcctgcgcccgctgtgcggtcaagccggtggagctgctgccacgggccctggccgacctggtgcgagaggctccgggccgctccatgcgggtggccaccggcctgtatgaggcctacgaggcggagcggcgcgccaagctgcagcaatgccgggccgagcgcgagcgcatcatgcgcgaggagaagcggcgtcttt

SEQ ID NO: 14078 - DNA, 368 bp, Homo sapiens
caaaaaaagtgtaacccaggtctctggcctcaaaaggggtgactatttttcttctgtgacaaggaacaaagtttagagagcaatacaagaatgaacataagcccttattaacccttttcccatttagaaaaaaaaagtgcagctcactgccagcactcatttaatttcacataaacacaatatttgaggctgaagcaaatctgactgacttcaatgtaaaaataaaatataaaaactgttctcaggccagtgcagtggctcatgcctgtaatcccagcactttgggaggccgaggaggatggatcacttgaggtcaggagctcgggaccagccttgccaacatggcgaaaccccatctctactaaaaa

SEQ ID NO: 14079 - DNA, 913 bp, Homo sapiens
gagcgagcgggcgggcgggcgagtgcgcgccccgcagccaggagcgaaatccgctatccgggtcttgccggcagccgagccgcagagttctggtcgactccagcgcttgaggcgaagtggccggtgaggccgggtgggcgggagagggaccggaggaaaggagacggggcgctgcgccaagttatcaaggccgcgatcaaagtcggaccaaggcagcgagtcgacagcaggtttccagaagtgccctaacaggactgactagcagccaggaggcgcaggaaggggcaaagagcgtgtggagagcttcgcccccggcgaggatggacgccccgggcggagggagcgctcgggttgcaacacccagtctggctgcacagctcgtaacccctgccctttggcggcaaacaagacgcatctaatgaccagccagccttcgtcttcctcctctgatcatcggacctattttcccccttttgtcgctctcctctttttttgtctctccaacccatgcggtaaactggtggtgcccaaggccctccatcgggtccctgagagtctcccaactgccggtccttagcgccagcctgcaagcccagacccgcctcgccaggctgcctgtgagcctatttttcatgtagctcttgccaaaagccctgatgtggtttgaagtagtggaggcttctttcactttgtgcctctcgtaccttaaccaaccctcataacctcctctctgagtagctcatggagcctctaaaagagaagtccatgttctcatagacattgtgttttctcactcttaaaactcctcattgtcatagctactcccccaatccccccatgctgtcctaacttcgaagtcagttgacttccagaagtccacgaaagcctataaattaaacttggttaaaagaga

SEQ ID NO: 14080 - DNA, 508 bp, Homo sapiens
cacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaagtcgacgcggccgcgaatttagtagtagta

SEQ ID NO: 14081 - DNA, 406 bp, Homo sapiens
cagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagccggttttgtctgactatgaaacgtgtcacagagcatgcacctttggccatcttttgcatttatgatttggaagagagatgtagcagtgagtgtggggccagggaggggaatccaacaaagccattctgc

SEQ ID NO: 14082 - DNA, 265 bp, Homo sapiens
ccccttcattatgaagttgatagaggttgtgttttaggggagtgatacaaaagatggtagttttcaaccagaagaaatcttaagaatgaattaaatggtgataaaaaaaaaagattcctggggaggggggagggatagctttaggagatatacctaatgctaaatgacaagttaatgggtgcagcacaccagcatggcacatgtatacatatgtaactaacctgcacattgtgcacatgtaccctaaaacttaaagtataataat

SEQ ID NO: 14083 - DNA, 305 bp, Homo sapiens
agattgcttgagcccaggagtctgaagctgaagtgagctatgatcacagcattgcacttcagcctgggtaacagagggagacccctatcttaaaaaaaaaaaaaaaaaaaagactatcctaaatatatatgtatatatatgtgtgtatgtacatatggtgtgtgtatgtcatgtatatagtagatactgtgtatatacactgtgtaattttgtaccaaagatagtaattgaaatgctctctgtagtacatggtacccctctgtgaaaacttgtctttgccatgcagttaaatttctttttgtgca

SEQ ID NO: 14084 - DNA, 641 bp, Homo sapiens
gagcactcattacatcctgtcattttagatactcttatctaggataggaaatataactcgtttcctgtctctcccactggaccatgagctccatcacacccttccaattttcttccttcagggaccaaacacgaggaaataccgttgaacaaccggctgttctggacccagcccacctcaaaggccaaggccactcatcaagaggtatatattaaatgtataaagctttttcttatatcagtaagaaagagagaagaaagaaagagaggaagaaagaaaggagagaaagttaaacatatctgtcaagaataacacaaaagtgatgttgtgtccttcttagtacatggtatcagaaggcttcttttttctttttttagaaatgaggtctcactgtgttgcccaggttggagtgcactccatagctcactgcagcctcaaatagatgggctgaagcaatcctgccacctcagcctcctgagtggctgggactataggtacattaccacacccactcataacaacagtttgtcttaatcttagtgatcagccaattccttggttaaggcagtatctgccaaatttctccactgtacagttattattttccctttgtaattaataaatatcttgtgagaagagaa

SEQ ID NO: 14085 - DNA, 280 bp, Homo sapiens
gtgcggcccaggggctgtgtgctggagtgggtacgcaacatcgtggccaaccgcctggcctcggatggggccacctgggcagacatcttcaagaggttcaacagcggcacgtataacaaccagtggatgatcgtggactacaaggcgttcatcccgggtgggcccagccccgggagccgggtgcttaccatcctggagcagatccccggcatggtggtggtggctgacaagacctcggagctctaccagaagacctactgggccagctacaacataccgt

SEQ ID NO: 14086 - DNA, 896 bp, Homo sapiens
cctgaaacttcaagttaaacctttaagctgttcatttcctaaaagggtgaaaacgcgggcaccctcgagctagttcatcgccttttaacctgtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaatc

SEQ ID NO: 14087 - DNA, 536 bp, Homo sapiens
agcggggggggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctcgcaccgcactcgtggctgctggagggttcaggggcgcggaaaacagggaacacgtttgtgcgcgagcccctggtagatgtccagaatgtctgtgttccaggaaaaggtcacctgcaagaacgggcagggcaactgctacaagagcaactccagcatgcacatcacagactgccgactgacaaacggctccaggtaccccaactgtgcataccggacagcccgaaggagagacagcatcattgtggcctgtgaagg

SEQ ID NO: 14088 - DNA, 2624 bp, Homo sapiens
agcggggggggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtaagatccatggttttccttggtggccggcgcgtgttcttgacatcagtctcggccagaaggaggacggagagccgtcttggcgagaagcgaaggtctcgtggtttggttctccgactacgtcgttcttgtctatttcaaaactctcccctttctctgaatttttcaaactgagatttaatcgtaagaagaaggggatgtatcggaaagctataaccgaggctgcaaatgccgcaagacacgtggccccggaaatcagggagctcttaacccagtttgaaacgtaactggttccctgaccaggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaatc

SEQ ID NO: 14089 - DNA, 2321 bp, Homo sapiens
agcggggggggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaatc

SEQ ID NO: 14090 - DNA, 2508 bp, Homo sapiens
ggtcccttctcactgtggtttctctctctccattgccaggtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtaagatccatggttttccttggtggccggcgcgtgttcttgacatcagtctcggccagaaggaggacggagagccgtcttggcgagaagcgaaggtctcgtggtttggttctccgactacgtcgttcttgtctatttcaaaactctcccctttctctgaatttttcaaactgagatttaatcgtaagaagaaggggatgtatcggaaagctataaccgaggctgcaaatgccgcaagacacgtggccccggaaatcagggagctcttaacccagtttgaaacgtaactggttccctgaccaggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaatc

SEQ ID NO: 14091 - DNA, 448 bp, Homo sapiens
cctattgtagaagactgaatggagctgtatgcctagcactcctttgctaagaactagcccttcaaccatccacatgattaattataaataatcagttgagtggtcctgatatcagcacctgattaaaaagagcctatcacagtaccgtactccctagatagtcaactggtctgtgaaagagtaaattagtcacatcacacccatcagtcccatctatgagactctggaaaatggaccggaaagatcgttatgtttaagtagctgagagcgtaaaacctgttgaaaaacacacatcatcctatttggagaatggagctctgcagaaggcaatctattccaaggattttttctttttaggacagagtcttgctctgtctcccaggctggagtgaagtggtgccatcatagctcaaagcagcctccaactcctgggctcaagtgaacctcc

SEQ ID NO: 14092 - DNA, 334 bp, Homo sapiens
caccaggccagactttatacttatagggcaacaggctaatggcattgactctgagcttgccgttagtccctgggcagcagggctgtggtccatctacccagcatcctgcttctaacattaaatgaaatgggataaccgtcttccaagacacctgccttaaaacttttgaatataccctaaatatctaaattctgcttaacaattttcattgtagatttatccaactatgaatttcaaagggtcctttggggtataatcctagtctttactttcacctttctttcctactctcttcctttgtgcaccctttgcttcaataaatgactacctgata

SEQ ID NO: 14093 - DNA, 403 bp, Homo sapiens
tggatatttagtacagaagagatattccagatattctaatgcagctacatcctcctcacaagatacaaatttaagtttatattaaatttagcataaatttccattttaaggtaagagataaacatattaagccactctagtgggaagttaagggggcagggacaaagaaacaatgaatgagaacttgccccccgccccactgcgctgccgccacccgactatcgacacggagcctggccgttatgtaggggctttcctagctcgactcattaacagctagtccacaacacgtataagtgcctgtgcatgtcagagacagcctccccaaggcacaaggtgtgaaagaaatagtctaaggctgcacctactggaggatgaagttttttgacaaataaataaaaag

SEQ ID NO: 14094 - DNA, 3405 bp, Homo sapiens
ctatagtattaggagatagggccttttggaaggtgactggagaggggcagcaccttcaggaatagaattagtgcccttataaaatagacccaagggaactttttcatcccttacaccctgtgagaacatgatgagaaggcaccatgtatgagccagagaatagatcctcaccacacactgaatctgctggtgccttgatcttggactttctagcctccagaactgtgagaaacaaatttctgctgtttataagctgtccagttaatggaattttgttattgtagcccaaatatactaagacaacaaccaatatagttaaaattactatgcatgttctactttatattaagttctagtgtacgttgtataatgcttacatcaaataaaaggtaaggttaatttacataaaacatgtttaggtaggataattgtaaaaattatttattagagaaattggtaaaattgtggctttgcatagaggcaggagaaagaaaagagcaaggcactagtgagaaaaattgctatggagaatattgagaatagatacaaggagacctacaggtttacaacattaatattggccaatacttgattggacagtttaaatttttcaacctgaaaggcctttgtgccccaaagtttggtaaggagattttgtaaaaacaaacaacaatagcaataaaaaatcagggaagattaagagatttcataaggagcaagaatttataggtaatacttaaaaggtataggtatgattactattttggtgaataataggcacatggtagactgaaattcggcaacagctactgtgcaaataagcatatctgtgattatggcttatatctggttggggacccctgttgtaagccattctttttagtacaggttaagctccatttctcaatcacagttctgttattttcatctgtgggaaataatgaattctgtttcagattttgattgtcttttgtgttctttgtcatccaacagaattgcacatttcactttgtaaaatttttataactagtgtttgacacttgaaactggcttttgagtcttctataatagtttgtgcagaagtctgaggtttaatgttatgatggccttattcatactgtagaaatatatactgcagcaatatgcacccaaatggtcaaatggtcagtaagctttttaaatgaactagctagatttttagttttgattttaattcttggtttgaattgctaaaagctatcttgaccttaggaaaatgaaagcttacatgaggtttagccacttaaaacaaagtatttctttgtgtctccagttcatgtgaaacctgacttttatttacaatatttatgttaggagcacttttattaggatcttttgaagcctttcaagagttttctttcagttattattaatagtactaataaagaaggtgagcaggatttaaagctgaaaggagcatcagagataattgaactttgtttatgccattcattgttaccctatgcaatgtcttttgtttgtttttaattaattgccaatatttaagaagagggtcatagaacagtcattattccagattctcttgaaaaactggaagatctggcaactacaggtttatgttcttgcatgttaacaatatacaggggctggaattaacctgctctgagtccctttagatgtgcatactctctccgatttgccacagttcccaccaattcttatttctcctctctttacttggcccacatcattgggcctatctcattaatttctattaaatattttattactgaggccattagtttatgacccctgaggccaagacagctgttaagaacttgcattactggtggcaaaattatacctttacgattacttactaggttttagaaatctcacttttctaacaagaggtattatggtaatcataagttcaaaataattaaagttcatttgagataattaaatcaaaacctctagtctgggttggagggtgataaagttatctggcgaaatatatgaacttctgttaccttcctcttctgctaaatgaatggtaaaatgaatcctgatttgtttaggcagtttacttatgaagttgggagaatttttttttttctttaaaggactgagtctggctctgttgcctaggctcaagtactgtggatcttggctcactgcagcctccacctcttggattcaagcagttctcctgcctcagcctcccgagtagctgggagccaccatgtccagctgatttttgtatttttagtaaatgagttttcaccatgttggccaggctggtcttgaactcctgacctcaagtgagctgcctacctggcctcccaaagctctgggattataggtgtgagccactgtgccaggcctgaggttgggagaaattttgtccatttctttagaaccaaaattggcaaccagagagtatttggatgttacacaaaatatttagtttccctttctagcctaaattgggttgtttatagcacccgtctctccatttgagaaaaatggttaggatgctggtgcagggatgaggccttattaaaacagagaaggtacccaaatggtggttcaaacacaggctggctaataagctgtgaggtgacttaccaaaaaacaacaacaacaaaaacccttgaacttctgctttcaacttctactttatgctagattatttggtccaatcttcctggtctaacacctggctacatataacaacaaacatctgcttgaatgtgttggaaaggtgatgattaattgccaggctgatatattaaataaaatggaaatctcaaaagttgaacttgctattcagtctgcttttgctctggaggggggatttgttagccaagaagaggctgaaaacatgagtagtgtactttgggagactagaaggacgaacgttaaaagtatacgacctccaaggttgtgactctggtagaattctttggttagagatcctgaaggacagcatcctagggataatggtgaaacagaagtagaccattcacatagagtgtagtttagcattaaatcatcaaggtggattagtaaattgtgagattttggaagtggactaaggtgaccttaggtttctaatgcccctaggaacctgaaagatagaaacctggaggaagaatattttcctaggcctcaaattatttgggtactttttcaaatacagtatctccacataccctggatacaggaggagaaaggcggaatgaaaactggcagaaacagtagacccaaaggggcaccaaataattgcattgtgaggtagactttaagtatgtttactgtattcaaggagataaaagatggaaaatttccatatagaattggaaactataaaaaagtcactgcagatttgttaaaaaaaaa

SEQ ID NO: 14095 - DNA, 2821 bp, Homo sapiens
ctatagtattaggagatagggccttttggaaggtgactggagaggggcagcaccttcaggaatagaattagtgcccttataaaatagacccaagggaactttttcatcccttacaccctgtgagaacatgatgagaaggcaccatgtatgagccagagaatagatcctcaccacacactgaatctgctggtgccttgatcttggactttctagcctccagaactgtgagaaacaaatttctgctgtttataagctgtccagttaatggaattttgttattgtagcccaaatatactaagacaacaaccaatatagttaaaattactatgcatgttctactttatattaagttctagtgtacgttgtataatgcttacatcaaataaaaggtaaggttaatttacataaaacatgtttaggtaggataattgtaaaaattatttattagagaaattggtaaaattgtggctttgcatagaggcaggagaaagaaaagagcaaggcactagtgagaaaaattgctatggagaatattgagaatagatacaaggagacctacaggtttacaacattaatattggccaatacttgattggacagtttaaatttttcaacctgaaaggcctttgtgccccaaagtttggtaaggagattttgtaaaaacaaacaacaatagcaataaaaaatcagggaagattaagagatttcataaggagcaagaatttataggtaatacttaaaaggtataggtatgattactattttggtgaataataggcacatggtagactgaaattcggcaacagctactgtgcaaataagcatatctgtgattatggcttatatctggttggggacccctgttgtaagccattctttttagtacaggttaagctccatttctcaatcacagttctgttattttcatctgtgggaaataatgaattctgtttcagattttgattgtcttttgtgttctttgtcatccaacagaattgcacatttcactttgtaaaatttttataactagtgtttgacacttgaaactggcttttgagtcttctataatagtttgtgcagaagtctgaggtttaatgttatgatggccttattcatactgtagaaatatatactgcagcaatatgcacccaaatggtcaaatggtcagtaagctttttaaatgaactagctagatttttagttttgattttaattcttggtttgaattgctaaaagctatcttgaccttaggaaaatgaaagcttacatgaggtttagccacttaaaacaaagtatttctttgtgtctccagttcatgtgaaacctgacttttatttacaatatttatgttaggagcacttttattaggatcttttgaagcctttcaagagttttctttcagttattattaatagtactaataaagaaggtgagcaggatttaaagctgaaaggagcatcagagataattgaactttgtttatgccattcattgttaccctatgcaatgtcttttgtttgtttttaattaattgccaatatttaagaagagggtcatagaacagtcattattccagattctcttgaaaaactggaagatctggcaactacaggtttatgttcttgcatgttaacaatatacaggggctggaattaacctgctctgagtccctttagatgtgcatactctctccgatttgccacagttcccaccaattcttatttctcctctctttacttggcccacatcattgggcctatctcattaatttctattaaatattttattactgaggccattagtttatgacccctgaggccaagacagctgttaagaacttgcattactggtggcaaaattatacctttacgattacttactaggttttagaaatctcacttttctaacaagaggtattatggtaatcataagttcaaaataattaaagttcatttgagataattaaatcaaaacctctagtctgggttggagggtgataaagttatctggcgaaatatatgaacttctgttaccttcctcttctgctaaatgaatggtaaaatgaatcctgatttgtttaggcagtttacttatgaagttgggagaatttttttttttctttaaaggactgagtctggctctgttgcctaggctcaagtactgtggatcttggctcactgcagcctccacctcttggattcaagcagttctcctgcctcagcctcccgagtagctgggagccaccatgtccagctgatttttgtatttttagtaaatgagttttcaccatgttggccaggctggtcttgaactcctgacctcaagtgagctgcctacctggcctcccaaagctctgggattataggtgtgagccactgtgccaggcctgaggttgggagaaattttgtccatttctttagaaccaaaattggcaaccagagagtatttggatgttacacaaaatatttagtttccctttctagcctaaattgggttgtttatagcacccgtctctccatttgagaaaaatggttaggatgctggtgcagggatgaggccttattaaaacagagaaggtacccaaatggtggttcaaacacaggctggctaataagctgtgaggtgacttaccaaaaaacaacaacaacaaaaacccttgaacttctgctttcaacttctactttatgctagattatttggtccaatcttcctggtctaacacctggctacatataacaacaaacatctgcttgaatgtgttggaaaggtgatgattaattgccaggctgatatattaaataaaatggaaatctcaaaagtt

SEQ ID NO: 14096 - DNA, 454 bp, Homo sapiens
gatgtaaaaacatgctttaataccgtcttggttgttaatttcaaagatttttctcaaaagacactctttgtaaagtaatgagaaaatattgccacttttaattattaaataatatttactacaatacaatttacttttaattattaaacatgcaatatattttaaattatttaattatatatgcaacgtatattttaaaaatgtattaaaataaagttaattgcatgttctctctaatcatgttcttgtagcatgcacacattttaaaaaacccagtacatgtaatttttgaaaatagtatgtaccattacacctttttatttgggagatttattagaaaataactttttattcagaaaagattatgacagaattagataaaaaggagactaaaatgtgtgttaaatcatgtaatattataaatgtaattaactcttcatcttccaaatattga

SEQ ID NO: 14097 - DNA, 134 bp, Homo sapiens
taaaaatgagaaacaaaataactcaaatgaaaaattcactgaacggacctaatagcagttcagacaccgcagaagaaaagataagtgaatggaaaaacaaagcaatataaattaaccaaactgaaaacaagttt

SEQ ID NO: 14098 - DNA, 810 bp, Homo sapiens
caagggtaacgtgttattccgcttggcaagttagattagattatacttgtagaacgtaaaataccaaataggtatagtttatttgaaatttaagtttgaaattaaaatgtcagtggtattggtttacttttttaagcttcagtgggcttaagaagactcaccatataaacaattctgtcatcccaactgaagaacattgaagatgggttcgtatcccagtgcacagagctttcttaatgaccagataaatggtcacagaacttgattctttcatgccttaaagatagaactccaagtccacattctccaaataagtggttcccagctcacattccctagattcatgttacacattaagtgatttttctgactcttcacctgtttgcgcaccgccccccccaccctgccaccaccttaaaacttgtaatttcttcttttactgcttttgttggattttactttgttgttttcagatctttgaaagtattttaaacatcatccttttggggttctgcatctctctcaagaatttattagacctttatgatcacaatctgttaataacatgctgtatattgtagcagtagtgattctgctaaaatgacctgtggttaaaaataatgggattggaacatggaagaatgagtagcacactacagctaaagagaagtttactttgtatgctaacataggatgtttttgtaattctctgattttcagatgttcagtgcctttccaggaagatattatgtatgcattgtgtttgtgtgtgctgtgaatactgaaataagatctttcttttctgctaaa

SEQ ID NO: 14099 - DNA, 485 bp, Homo sapiens
gctttcccgcagctatcccagaagagcctaattcctccacatttgccattgtcacaagaggctacttcccctcacccaacagcaggtcctgttgctcacttctgcctcctatatttgtgcaggtggaagtgcttgaccaaacctgggtcccatgttgaaccaagtggtaaagaagcttggaaaacatggttcctagctttccagggaggcaactacagaggagttgagatggatgctgaattctttattgtatcagccatgattggtggctctagggccaggcacatattttctggggttcttccctgagtcacttcaatcatataccatctgggccatctaaacttgaagctccctctgcttctggccctatgttaatttttgaattgtcaccaagtagtgtttttgaacagaagttcaacatattcagactcactgagtaatccatgttcacaaggctctcaacctcaccagcatatgaaact

SEQ ID NO: 14100 - DNA, 1064 bp, Homo sapiens
tctgaattgtttctagcttatggctaccaagaatagagtggctatgaacacccttataaatgtcttttgatggacatgtatatgcatttattttgaaacatacctaagaagagaatggctggcctgggtaagattatgttcagcttttagaaggtactacccaatggttttctaaaatacttgcatctgcacatgccatgtcccagctacccaagaggctaaagcaggtgtattgcttgagcctaggagttctaggctgtagtgccctacgccagtcgggtgtccgcactgtttggcatcaatatggcgacctcccgagatggggggaccaccagattgcctaaggaggggtgaaccagcccagatcagaaacaaagcaggtcaaaactcctgtgccgatcagtaatgggactgtacctatgaataaccactgcactccagcctgagcaacatagcaagatcctgtctctaaaaaaaatgaataaaatacttgtaccaatttatacttccactagcagtatatgagagttccaggtgatttatatcctcattaatcatagaagggttttttctgtctttttattttagctatttcggtgggtgtgtagtagtatctcattttggttttaatttatatatttccctgatgattaaaaggggatgtcctgtaaatgttttcttttgtgaaataccatagcacacatttaagggataaagaaggcccgtcccagaggcaatgttgcatacagttcctgtcccactggccctgctgactagatggggagtccagggtaacagctacccgataccacggctcgagagttaagatttatggcagattgatacctgcctgggtcgcatgatgcaatgagtatttttagacgagggaattatttcaaggggccatgatagggaggccttgagcttaaggtatccgctttcaaggcctcctatcatgggccttgaaggcggataccttagctcaaggtgggacaaaccaggtatttttaggcccagggggtcagatgaacctggggttccctctgcccttcccctcactcccc

SEQ ID NO: 14101 - DNA, 239 bp, Homo sapiens
agttcgcagacacaataacataaaaagcagtgctgacgtttgaacaggacttttggtttcaaagccattgtaccttataggtgtgttccatatacatttattaattgaattaacgggcaaaggccaatcatactgggctttaacttccctttagtcacaagatgttcttttagctcccagagtgaagatattaaaaacaagaatctggctttggttcagttgctaaaagcatgtgtagt

SEQ ID NO: 14102 - DNA, 401 bp, Homo sapiens
ttgtagttttgcctccagcttgacatttaattcacttaatttatgaaacaagtatagcacatttcatatttttggccatatgttgcaggttttgctctcagtccatttgtgggatagtgaagttgtttcctttctcttttcacagtagacggataattaaccttggcccagtaatgcttatttctgaagaacaaccagctcagcctgcattgccaatccaaccagaaggtacaagggtcgtgtgtgggcactctttcctgtgttggatcccatgccatcctcagagttcttagtttattccttcattttggtggagcacatctactctttgctttctgagaaaagatgcagggaaatattatatttgagctctttttctcttaagtggtttttaatctgat

SEQ ID NO: 14103 - DNA, 2798 bp, Homo sapiens
tcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatattccttctggaataataactttatgagagcaagaaccctggtagtcttgttcacagctttatccccacttagaacagttcttagtgtacatgtgctcaatttacgtgaatgaatatgcatgaatgaataaatggttgaatgaattgctattttaaattcttaaaaaaaaacttgaatatg

SEQ ID NO: 14104 - DNA, 2640 bp, Homo sapiens
tcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatatcaaacaaaaagaaacaaaggg

SEQ ID NO: 14105 - DNA, 2745 bp, Homo sapiens
tcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatattccttctggaataataactttatgagagcaagaaccctggtagtcttgttcacagctttatccccacttagaacagttcttagtgtacatgtgctcaatttacgtgaatgaatatgcatgaatgaataaatggttgaatgaattgctattttaaattcttaaaaaaaaacttgaatatg

SEQ ID NO: 14106 - DNA, 1717 bp, Homo sapiens
aggtaccggcccgaaattccccgggtcgactaactcctactaaattcgcggccgcgtagacgatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatattccttctggaataataactttatgagagcaagaaccctggtagtcttgttcacagctttatccccacttagaacagttcttagtgtacatgtgctcaatttacgtgaatgaatatgcatgaatgaataaatggttgaatgaattgctattttaaattcttaaaaaaaaacttgaatatg

SEQ ID NO: 14107 - DNA, 2300 bp, Homo sapiens
tcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttc

SEQ ID NO: 14108 - DNA, 2378 bp, Homo sapiens
tcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagaggtttactaactgtggaatctccagaattacaagtcccatataagaggagatggagctacaagtaaatgtttccttgagcggagctcccacctccatatacagccattgccagtccagacgccagtggtattccagtaataaactgccgtgtgtgccaatcactaatcaatttggatggcaagcttcaccagcatgtggttaagtgcacagtttgcaatgaagctacgccaatcaaaaaccccccaacaggcaagaaatatgttagatgcccttgtaattgtcttctcatttgtaaggacacatctcggcgaataggatgcccaagacccaactgtagacggataattaaccttggcccagtaatgcttatttctgaagaacaaccagctcagcctgcattgccaatccaaccagaaggtacaagggtcgtgtgtgggcactgtggaaacacattcctgtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttc

SEQ ID NO: 14109 - DNA, 2418 bp, Homo sapiens
tcccggaggcggcagcagcagcagctgcagcggcagcagcggcagcagaggcagcagcagtagccaccactccgccgaggccgcaaccccggctcggcctccccaggccccgccgctgccgcagtcatggctgctgatggggtggacgaacgctcgcctctgctgtcagcatcccactccggaaatgtcactcccaccgccccaccgtacttgcaagaaagcagccccagagtggatggaactgaggttcaacactctggcaaaatgcccacactgcaaaaaaatctcctcagtgggtagtgcacttccacgaagacgctgctgtgcatatattaccattggaatgatatgtattttcattggagttgggttaactgttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttatttgtccacagttggagatgttggataaatgtcttttctcaaagatcacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaattatatgctatgtcatattccttctggaataataactttatgagagcaagaaccctggtagtcttgttcacagctttatccccacttagaacagttcttagtgtacatgtgctcaatttacgtgaatgaatatgcatgaatgaataaatggttgaatgaattgctattttaaattcttaaaaaaaaacttgaatatg

SEQ ID NO: 14110 - DNA, 300 bp, Homo sapiens
ctcatttaaactaaataattcagatacagaacatcttgtcatgtttgtctagagaaaatggttccataggtaaaattaagaggctaatttccaaagttgaatattggcacaggaaaaaaaaccaagtatgtatatagagagaatagctcagaaagaaaaaaatgtaactctatgcaattgagagagacgatgtaacttgaaaggattaacaatgcacaacgtcattgatcagctgaaaagcaggtactatctaatgcacacagccaggcatgttctgttaacttcaaagtgttctcagcc

SEQ ID NO: 14111 - DNA, 375 bp, Homo sapiens
attaatacccccatgaccagagatccaaaaatcctcaaaaaaatattaacaaataaaatcccacaatgtataaagggaataatacaccacaaccaaaagggctgtgtctcaggaatgcaagacttaacatttgaaaattaatcagtgaattccatcgatattaacaatctaaaaatctaaaaagcgcagttatatcaattgacatagaaaaagcatttgacaaagattcaacatccattcatgagagcaacactcagcaaactagaaatagaagggagtgtactcaatgtgatataggatcaggaataagacaaatatgtccactctcactgctcctattcaatattgtactggaaatactgggtagtgtataag

SEQ ID NO: 14112 - DNA, 504 bp, Homo sapiens
gtcattggaagctggtattcacagccagtacaatggatgatggaacatcctgagttgtggtgtggcaatcattagacaaatagtattcaggaaatttggtggcaaggagaactatattgcttcagtacaaaatctatatcatttatgaagaaacatagtattacaagtagtaacagcattgctaccattttctttttttgcagaagggccaggaatgtgtaaggcctgatctatgctttcttttattttcttctttttttaaaacataatttcaacttttattttagattcagggggtacatgtgtaggcttgttacctggaatattgcatgatgctgaagtttggggtatgatagatcccatcgcccaggtaatgagtgtagtacccaatagttagtttttaaatccttgccaccctccctgacttcttcttatttcaggagatttaaattagccaaaaataaaacatttgaaaataaagggcctgaatggtccttttctaaa

SEQ ID NO: 14113 - DNA, 309 bp, Homo sapiens
ctattttgtaggctgtttactgtgttgtttctttcggtgtgcagacatttgttatttaagtgttttttgcattgggctcctctaacactcaggatggcccactggcctaagcatgaatacatcttgtcattggttacttctttgctttcaaccttccctaaatctacttttagaaaggaaacattggccaggcaccctgtctctcgcctgtaatcccagcactttgggagactgaggcgggtggatcacttgagatcaggagtttgagaccagcctggccaacatggctaaacctcatctctactaaaa

SEQ ID NO: 14114 - DNA, 195 bp, Homo sapiens
agttaatcatatctgctatgtgccaggctaggttcttggggaataccaaattgaataagaaatgagcccagctttctgggaaccaacaatctagaattcttggtagagagtgacagacagcagttcaatcacagtggcaagtgttaggtaatggaacagaattctgatataacaagtactgtaaaaatggaaagg

SEQ ID NO: 14115 - DNA, 397 bp, Homo sapiens
acaacaaaatagctgggcgtggaggtaggcgcctgtattcccagctactagggaggctgaggcaggagaatcgcttgaacctgggaggcagaggttacagtgagccaagatcgcgccattgcactccagcctgggcaacgagggcaaaactcttctctcaaaaataaataaataaataactagaaaaaaatgtggatacatttggaaaataatttgggattgaagaaggcctttccaaacagataaaacacctaaaagccataaaggaaagtggttgacaaatttgattagataaaaacttttccacagaaaagttaccataagtaacattaaaagataaacacagatgagaaaaccagtcttcaatatattgacagggttgccttgatgtgaaaaa

SEQ ID NO: 14116 - DNA, 396 bp, Homo sapiens
aagtagtatctcacatctttaaagtattttacactctcttgggtgctttcacttgcagtagctctccgacacgcagaagtcaggagaaccaagaagattaccttcctaactatgcagctttatggagaccaggatgagctaacaggagacatggtgaagggtgcattcatgaaaagcacacgtcacagtgtcaagtgtacttgggaaggactcacagaattaaaacacattttctggtttttttttttacatttaaaactttttattttattttattattattatactttaagttttagggtacatgtgcacaatgtgcaggttagttacatatgtatacatgtgccatgctggtgtgctgcacccattaaattgtcatttagcattaactatatc

SEQ ID NO: 14117 - DNA, 181 bp, Homo sapiens
caggaagtcctgatggtcccagttttctttgatggccacatctggacttgcctgtgtgtaaagtggacacaaaagacggggcccctgccgtggccgagaacgtggcggtggctcctgctgcttgccaggcagcacgggagctgggtctccctcggacccctcaaaagatggttcctcaccg

SEQ ID NO: 14118 - DNA, 321 bp, Homo sapiens
ccagtttgagttgatttttgtatatggtgaaaggtaagagactgatatcattctcctgcatgtagatatccagttgtaccaacaatatttattacagagactgtcctttgccttttgtgtgttcttggcacctttgtcaaaaataagttggctgtaaatatgtggatttatttctgggctctctattctgttccattgttctgtgtgtctgtttttctgacagtatggtactgtacatgataaatatgtaccattttaaatgtcaattttaaaaataaacaaatatttttgaaaataaaaaaagataaagctgagaaataa

SEQ ID NO: 14119 - DNA, 381 bp, Homo sapiens
tttctgacgactacgtaaatctttccttttggagctagatgatatttggatatgtgtgggtaaaaaacaacaacaataacaacaaaactgacattttcgaaagcttagctacctgcagtcctcttctatggttttttgtatttggtgaataatagaacctttttagttctcagagttctttgtgtaggtaagggtggcccatctaattaccaacaattagatgaacaagaacacctgaccctcgccagctcaggttctaatgagaaaccagtgcagatagtgtcagatacaacagggctcactcagccatttgtatgaaaataacagaaacctagtagcagccatgtaaagtcattttgttctttctgtcctagattccag

SEQ ID NO: 14120 - DNA, 2391 bp, Homo sapiens
ccccccccggcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaaggctgttgatgtgtgggccattggttgtctggtaactgaaatgttcatgggggaacccctatttcctggagattctgatattgatcagctatatcatattatgatgtgtttaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacagagtggatgagaaaactaagaagtgttctattccatttgttaaaccgaacagacattccccatcaggcatttataacattaatgtgaccacattagtatcaggacctcccctgtcagatgattcaggggctgatttgcctcaaatggaacaccagcactgagaaccattttggttctgaactggatgatgctcttgcacttgagatgacatcttcttgcagcaagagtgctgatatcccaagaggagagattcatggttttgatcatttccttctgaactgcctgcattttctgaggaaggccttctagaagaaggaaagacaaagacttccaaatgtttcaaaggaagattgaacaaatggccctccccaactgttatcccattacctttcacgtccaccgatgctatttcaagacatatccagtggaataacagtgatatggttcttgttacatgaatgtgtatttactgttaggagattgtatattttaagttaccatgattaaaagtgtgtaaaaaagggggacagagagaaatactataaaaggccatgttactcatgcattgaaaaa

SEQ ID NO: 14121 - DNA, 2096 bp, Homo sapiens
ccccccccggcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaaggctgttgatgtgtgggccattggttgtctggtaactgaaatgttcatgggggaacccctatttcctggagattctgatattgatcagctatatcatattatgatgtgtttaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacagagtggatgagaaaactaagaagtgttctattccatttgttaaaccgaacagacattccccatcaggcatttataacattaatgtgaccacattagtaagtaagcagttctcagtagtagaagagcaaacaccagtcagctctagacttttattaaaattaaatatgatagtgaagtattgagaattttgtttggatacacataaagtgaaaccttaattgtgcatatattatcccaacccatcatagtcataaacgtgaaattctgaaagtttaagt

SEQ ID NO: 14122 - DNA, 414 bp, Homo sapiens
gaatgcagaaaaaaaactactttgctaataattatattctcatttcatcactcatcatcacttcactcatacatcacttattttcttggaatatggtggaactcacatattttaaaaatgaattaattgaatgaatgattttatctgtataaaaattttgtcatctttcaccaatgagaaatccacttcctagtaaccttcagctgtttatgtgaattcggtgtactttgaatatagaatgcctgaaacgcatctcacagttcaaatgttctgcagtgcaggtcacctgtgatttttaaccaacacaactgaaaaggaaaatcatgctattagcacatatggactgcaggttaataagaagtcactacaaactgccaagcaattaagcaggaaggttagagataggcaaaatat

SEQ ID NO: 14123 - DNA, 247 bp, Homo sapiens
ggaatcttatcagtctgtatgttcctataatattcatcaagaaaatgggcaataaacaagatatatacagtaggtgagatgtttttgttggcttttctcttttgtaactctccttgtcatgcaggagggtgccctgaaatattgagtcttttattttctggaaagtgctcaattttcttgactactccatttggggatcagaaatttcttttcatttcagagggttttcaaatgccacataacttct

SEQ ID NO: 14124 - DNA, 376 bp, Homo sapiens
acatttactaagtttgtctcatttgatcttcacaattctgtgaaaaaggtaggacagatagtgtcactcctacttttaaagataagaagtttgggcttcaaagaaattcagtgacttgccctgagataaatagctagttatgtctgctatcttttgcattagttttcattctcctatatcaaagagtttctatgcagaaagacttctatatgatttacttataatttctaaaatataaaattcaaattgttgaatttccggcttttctgcatttaccagaaaagtatgccatttaaaaaaatagaccattgaaaaaacatggaatgcttcatgaatttgtgtgtcattcttatgcaggggccatgttaatcttccc

SEQ ID NO: 14125 - DNA, 1266 bp, Homo sapiens
  misc_feature (552)..(552): n is a, c, g, or t
  misc_feature (574)..(574): n is a, c, g, or t
tattttttttttcttttaagtagagatggggtttctccatgttggttagactggtctcaaactcctgatctcaggtgatccacctgcctcagcctcccgaagtgctgggattacaggcatgagccaccacgcctggctgtttcagaaacttaaatgtgagttcccattgtctttaaattcatgtccaagctccctggagtaccaagcttccaaaattagacccaaagtaatcttgttaggcatgactccaaataagcatgctgtatagaaactcttcatttcagacaagatactttactcctaatcacccacacaccccttagagcctccttccttcagccttggatttacgtaaggtcgctctttgcctccttttacctccatctactgaaactgaacctgttttccaaggcccaaatcaaagtctgaaattttcccatcacctgatatggaagttatttataaaattaataatgatgattaaaaacaatagctaccattctttgggcatttactctgtgccagccagggtaaaatcacattctagaaaanatggaagaatcaatgagcccangtacgtaaagggctgagcccagaccctggggcatgtggagggtgcccaacaaaaattggctgaattgtcaccaattgtgccattgaaatgtcacagtgacatttgctagcagtcaaaatgccatatcttgtccacctgaaagaggatgagcactgaggaagtggtttgggagaggaagccaaccaattccttccagcattgcctggcacgactttctgagccttaggcaaataaaaatatctttgttccaaattacatctatcgtctggtggtattgcttgtcttttacatttctattatgtgtgtctcttatgtatcccttcacttccctgttctggcaccaaaatgcaaaactcagacagcattaggaaaaagagaagttcttccaatgtgatccatagtacacagtcatgtgggagactcaagagaaagctccttcctggtgggcagaggtgctccctaaattctcattccctttgagatcaacagcaaagtttccccctaatgctgaatttgttcttgctgtttctcaaaccaaaatgcaatttaagagagggttattacataggaatgttaaatacatggctttcatgctaaatctgtgacaatctttccccacattccagtgccgggaaattagcaatttaaatctctctttgaactgtattgtggattcactcctcagagcttct

SEQ ID NO: 14126 - DNA, 412 bp, Homo sapiens
aacacatgtagtagtgtcatttgaccctagtcttggggctcaaagatggcttccttgaagaagtgactatggagctgacttgaacaatgaatagcagttaagtggatgaagtgagaaccaggcagaggaaagagcattcataagagtcctgtcacgggagaaagtgtgggtgtttttgaggaactaagaccattgcggttgtatggccaagaagtgcctggagaagtagtgactagactagaaaaaagcctgtgggccaaattaaagattttgatttttatgctaaaaatcctgggaggggccgggcacagtggctcactttgggaggctgaggcaggcagattgcttgagcccaggagttcaagaccagcctgagcaccatagtgagaccccatctctacaaaaaaatgag

SEQ ID NO: 14127 - DNA, 290 bp, Homo sapiens
cctttcaaggactcaccttattaggacagtcaaagcaggataaacccagcctaaagtcaactaattgaggcccttagttatatctgctaaatcccttcacagcagcatctacactagagttgcttgaataactgggggaaagtgaatgaccgggaggtggctgttgggggccatcaaagaatcagcccagcaagggttggatcttccttttgtgtttaatttggacacagttggaaattgaagttcaagtaaagtgatcattgtgaatggtaataaaatgcatcctcttc

SEQ ID NO: 14128 - DNA, 560 bp, Homo sapiens
gatttaacccaggaaaaaactttccagtgggccacagaaatggagcagattctgctcggatagagactgcttctgaggttcatctgtgtcttcagcagaatcccccaggctggtggacgcaggagggagcgaggaggcaggagtccccacggacatggctgcacagcctggggccacagggcttccaagagggagccagtctgcagcagaaaagcccagagggcagcttccgcacacacacaagcacagcccccacccccgacactgcagacagggcctcttccggaaggcgctcccccaagctcatgtcccacagcctgggcttgttggaggccatctggcctgcagatgctggtgagcctccatggtgtctgtccccactgtggcagggacaaagtccccaagaggaagagaggacctgactgctcttcagagcttgacacacagcacccccagccagaagctgacctcccacttgtttgaggcagtgttcaaggggctgtccacagcaagagagatgggactgggctccatctccaaagaggcctccctgagccagc

SEQ ID NO: 14129 - DNA, 327 bp, Homo sapiens
aggtatgcttcaagaaaataaagcatctaccatagttgattttccaggtgatagaacagcattgaaagcttttaggcaacagaatcatataatgagaccctcttgaatataacaaacattttttcaagcatagtatagtaaactaaaattaacactcatggagttttccatgtgtcagataatatattaagcattttacatggataattaaatgtatgtaggtaaagaaggcttaaactgcttttaaagttagtttcattattaaaaaaactagtattcattattaaaaaacaggaatctttgattgcatgtctgaaaatgtgtagc

SEQ ID NO: 14130 - DNA, 454 bp, Homo sapiens
gaaatagattactagctggctggagagagaggttatcaataaaaacaatgttatatgctggtgtagttttctttttccttttcttgcaaatatgttaaaaattgtacatcaggaatataaaccattcagctttctttgacaatttgactcaactggaacaaatagggttgagaatgatccagagaaaagtaaaacaaattggctatttatggagccagttactaatataaatggaaatgcttttagaacaggctctttccagaaatctcccagactgactgaaatagagcagaataaaaacagaaaattactttagaaggtcatttgcatattagatgctaccatttgttagttgctttgagtttgtgaagttcctaagtcaagtactttgcagattcaaactgataggaaaggggagaaatgtaatggaaagttggagcacgtaagaaaatcc

SEQ ID NO: 14131 - DNA, 982 bp, Homo sapiens
tagggtctgggtctcattttttgtagagctggtcttgaactcctggtccctttttttttagagctggtcttgaactcctcctgcctcagcctcccaaaatgccaggattagctgtgtgagccatgcttataccactgggcgtgatggtgttgtttttattgatcacaatgtgcttcaaggtaaatactacttcagcatgatacccattttttaaagcttaaaaataaatatggcaaaataatatatttttagatatatctatatttatacctacacctgccctctctatacatagatatatatgtagactataaagaaaagcacagggattatggacataaccttcagaagagtggtcatctctgtgatgaagcaaggggactggatcagagaagaaattccagcagtcctgtagcttccacaggactagaaatatttcattctgcatgaagtgatgggtgtatggatgttatttaattgttatgcttcataacttagattcacatcccactttgagaatatctcctatagaaacaaaggacttgtatttaagaatgtgtaagaagagtcaccacggagctgacacggaggctggtggcacctgggcgcaacgccgtatgccaactagcctaccgcgtggatcacggagctcactgacgagaatgtcaagttcatcatatatatatatgtagatgtgacttaatatttcaatgagaaacactgaaataaaaaaaaaagaaaccaaaaagcatttccaccatccatcagttgctaagtagccatgtgccccacctaatgtaatctaatttatcatgtaattttggtttaagctggacattaagacttgcaaagaaatggcttttgcctaagattaatagtaactactaatattctttttcttcaatctgcaaaggtaatgttaatgaaacttgcatgttaaaattctgtaattataagtaaagtgttttactaagtaccttaa

SEQ ID NO: 14132 - DNA, 410 bp, Homo sapiens
tgattctctcacagtctggaggctaaatgtcaaaatcaaggtgtcagcacaacatgctctcactgagaccgttaggagaatccttccttgcctcttcctaccttccgatagtggctggaagtccttggtcttcctctccttatagataaatcactccaattatttcttctgttgtcatgtagccatctgtcttcgtgtggtgttctcatatcttataaggacaccgatcatattggattaaggcccattcctatttccaagtaaggtgacattaaaagatactgggggttagggcttcaacacatgaatttgggaaagggggtatgcacaattcaacccataacaccaactgtaataaattctatattgttgtaaaatatctctttggtagcaaagttagtatatgccaa

SEQ ID NO: 14133 - DNA, 795 bp, Homo sapiens
tctaggcaggtgagccgtgcatggggcccagcgacagttgccgattgtgatttattagtggaggaaaatttggaattggactttaccgttgggatttacttgcatttgaaagcaatgcagttagcagtccatctttcaacactgaatgtattttctctgcttttatatctttctgatgaattaagcacttatgtgaggtgagggattgaaaacactagcagcctaatctctcagtagatctgcttgccagataacagctgtatggaaaaacacggggaccaattttacattgtttctccaccaattcataccagccgtgaactgtgatgctccccccaattctacaatgggcagataatgagagttccttgccctccagttctccaagccgtttcgaagaagacctgctaattgaattcagttgtttgcagttttaaatgttcatgctttccacaaaacaagaatatattaaactcatttcatctgtcatccaagaagaattggagcctgcatttttattaccaactgacttgtgtgttcatctttatcccagattttttttgaaatgtttacaatgtaattaaaaacaatcaagtcaaatgatgtatttgaattgttccctttgggagaagataaaggagaaaatatagctacaattgcttcatttttgctgagtatttctgccttctcaacagaaatacatcatgtatctgctcacctagagcgttttgtaatgtcactggtgatttaacaattacaaaatattgtaattaaatgttcaaatgctcaaaaaag

SEQ ID NO: 14134 - DNA, 914 bp, Homo sapiens
aggcacatgctgccaggggggaactgaactcagggaatggggcccccagctcccattggggtcggcgaacctggtgccaccccttagacaaagtcccagtctcccagaggcttttaccagctggccccattccttctgctgctgggtataataaggtcctctcaacgctgaagtgcctgtgaaacacagcccagaggagttctcattggtcctatgggctttgtcttcctctctgccccacccagataatcgctgctgcccctccactcccaagatgcagctgtgattctccatccccacacatccctcatcaatggttgactgcaaagaagtgagaagccaagcttagattcatgctcatgcctgaacaccctgagagcctggtgctggagggctgggtatccccttggcctgccaccagcacctgcacccacaccaggctggagccacgctctgcgcacagaaggtggccttgatttctcaggcacagctgacctcagagatactggtcctgactctgccaggtctcttatccctagtcttgttgccccagttccttctggattcaaggcgatgttgcctcaaaacaaggaccaggtgctgccacagacctcagtgctccctgggcgccccacttggggcttctcacaacttgtggactcctctcctcacaacctacagcctctctctccccatcagggcctccctccctctcaaccaccgttctcttccactcagtcccgtcgtccctcctcccctccaccagcatccccctctcctggcttccaattcggctcttgtgactcaaattctgactttgctccaatccctattctccctctctcccaagttcccctactttctttcaccagaactacctctctctccccgtccacgtgcatcctctccctcca

SEQ ID NO: 14135 - DNA, 515 bp, Homo sapiens
acacaaaaacctttctcattctgtgctataactagttagcatttaattgggtggatgtggtataactagtgccttgttgatattgatgcatatttacatggttttgctgttataaacaatggtcccttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgccc

SEQ ID NO: 14136 - DNA, 417 bp, Homo sapiens
cagctgtaccggcccgaaatttgggatcttgctattataaatcacactgctataagtaaccttgcatctaaattacttcaaatgtgtaactatatgggtaggataatttctagaagtggaattgtgaaccaaagttttaggtgcatttgtaattttgatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttccaggtttttttgttgttgttgtttaatagagatgaggtcttgctatattgccc

SEQ ID NO: 14137 - DNA, 330 bp, Homo sapiens
ctgataagaaaaaatacaaagctgcttaatttaaaatgaattccaattaaacagagtgaacaagtttaaatgcaaactcatatctctgcaaaagggaactgtagaaggagctgaatattttcagttaattagtatgcttttctgtttcttgagaaattatatgtggatgacttacaggtgtatcaaatgaaataaatgtgctttctaaaagataatgtcaatgaagggaacatttggactgaagaatagtttcaaattataagacacatgcagaggcacatacttagcctttgcttcctgcagcagatgaccactttctaataaaagtcc

SEQ ID NO: 14138 - DNA, 403 bp, Homo sapiens
ttaaattaaaaattgtggcaacttaaaattagattacagactgattcttccaaagtcacccagacattaggaagggtactattattctttttaagaagggactattgtgagagatggtttatagagaaaaatagattaaattctgcatttagttaactttaattttgtgttatatcttgtgggtcatagtcactgacaaagagagatggtataaaaaacaaccacaagctaatagataataactcttactatgtgacagccacagcactacattccctacatacacaatctcattcaaatcttccaatgacgattttgagtgggtacttttattgttcccataacttgaccaagttcacacaaatcaaaagtggcagatcctaggcttaaactaagatcagcc

SEQ ID NO: 14139 - DNA, 248 bp, Homo sapiens
  misc_feature (238)..(238): n is a, c, g, or t
aaaataagttataatcgacaatagggcataagaaaagaatgttgtaaaacattttctaagaattgctaaagcgtttaaatatcctcttggtaggatccgtgatagatcaaaagttgtaacacgtactgcttaggagaagagaagcagaaagatcagaagcggtggaggtgctgcaattcttagaaaatgttttacaacattcttttcttatgccctattccgagattataacttattntgtcgacgcg

SEQ ID NO: 14140 - DNA, 411 bp, Homo sapiens
cagccagttaaaagctatttttaaaggtattgtgtgcacactgttgtaatttaactcaactaaaaacgttaagttgtgctgaaagaaataagctgaaagaaattaaatactagtcttttttgtttgtttgtttgtttgtttgctgagacagagtttcactctgtcgcccaggctggagtgcagtggcatgatctccgctcactgcaacctccacctccctggttcaagagattcccagcctctcgagtagctgggattacaggcaaccaccacctcgcctggctaatttttgtctttttagtagaggcagggtttcaccatgttggccaggctggtcttgaactcctaacttcaaatgatccacccactttggcctcgcaaattgccgagattacaggcatgagccgctgg

SEQ ID NO: 14141 - DNA, 222 bp, Homo sapiens
cactagctcatgtacttacctgtttcatgacttgggagaagtttttaacctcttggaacctccagtttgtaaaatggaattaaaagtattgcctacctcataaagtaggaaattaatacatggaaaatacaacagtgcctgacatgtagtaagggctaaattgatattagctgacaaccaccacatagtattgaatttttctgcttatatatctgcctaacc

SEQ ID NO: 14142 - DNA, 720 bp, Homo sapiens
agtttccaacattttattttttcacgtgtcttgccatagacctctttgggttttatcctatttggggtcctcacagcttcttaagcatataggtttatgtctcttgccaactctgggaagcttttagccatttacttctttatgttttcaggcttgtcctcttcctcttccccttccagacatagatgacaacatgaaagtgagaccttttgaggtagtttcacaggtgcctgaggttctattcactttctccccgagtctattttttccctgctaagattgtgtaatttctactttttcattggcagtggatggatttccttgctctgcaccatccattctgctgttgagcctatgtgccagactttttattttggtggttgtatttttccacttctaatacttcatttgggttctcccttaagtcttgtatttatttgctaagactttcctacttgtccatttatttcaagtgtgctcataattactcgctaaatcattttcatcaggcttgcttgctttaaaatgtttgtcagacaatcccagcgcttctctcattttattgccagtgtgtgcttgctgcctattttcattcagtatgagattttcctggttcttggtatgatgaatgattttcaatggaaacttggacttttgggtattatgttatcagactgtcgattttattgaaaccttctgttttaactaccaaaaaaaaag

SEQ ID NO: 14143 - DNA, 331 bp, Homo sapiens
acaaaactgagttggagtatactttcaactattataaaaacagaaataccggccaggcacggtggttcacacctgtaatcccagcactttaggaggccgaggcaggcggatcacgaggtcaggagttcaagaccagcctggccaatatggtgaaaccccgtctctactaaaaatacaaaaaaattagctgggcgtggtggtgcatgcctgtagtcccagctactcgggaggctgaggcagaagaatcgcttgaacccaggaggtagaggttgcagtgagctgagatttgtgccactgactccatcctgggtgacagagcaagactctggcc

SEQ ID NO: 14144 - DNA, 384 bp, Homo sapiens
gccacaggatgctacagtgggagcctgaatgagtgctgttcatcacatccttttgtgtcaacgcttgagttctttaggaacttcttgagtggctgtttgtcactgtgttggtctgaccgtggatggttctgctgcgcccccatacacagccacttatggtgctccctcccctctccttcaactgctggcccagcacctctgtcctcatcgtctcatctcttaccctgtcagtttttccccgtctctggcattctcttctagccatagcccaggtcctctgtccacagcctttcttgccattgctggcctttggcacttggccagcattaactcctgaggtgacatggttctgtttattccaccgggagagtaacaatgacaagg

SEQ ID NO: 14145 - DNA, 530 bp, Homo sapiens
gaaaaattgatcctgcatttctgcatgacaacacttgtgttggtgctcaccaggctacccaccactcctcattgtcttctcctgggcatgctttcttccttatggaatctgcctagtctcccaatgagcccggtaatagcccagtacacgtaggctaaccttgttattccaaaaatccctctagggtagttcccaaagttgtaaacttctaaaaagtttcaacattgatatggagttccaaaaaagtcaaggacaaatctgtatggctccttggaatatccatttttgcatacatttatctaggaaggcttatgaagcctcttctactacaagaatctcctgatgaacaagaaagtaagaaggaattacaaggttatctgcatttgtgaattactcatagttgtgaaaaactacaaaagaactatagggaatgattgttctaaacctattcacccttcaatttaataactcatagagaattaagatattaattcattcaatgacaaatatctattcaacactcattgtga

SEQ ID NO: 14146 - DNA, 333 bp, Homo sapiens
atactttaggttttcctctcatctcaataaacagctatttattgaacatcttctgtttacaagagctttgctagatgctgtagggagggcaggggtgagcagaatatttatctgttctcaaagagttgaccattgggtaagagacaaagtcagtgaaaggtaccatttgcaatcggataatagaacagagatatcaatgaagagagtcagaattacccaaatcacttttaaaaatccacagatgcccagactccgctctagacctactggatccaactctgataaaagtcaccaatagacttggtgggggggaaaaatgaggtaaaaaaaaaa

SEQ ID NO: 14147 - DNA, 972 bp, Homo sapiens
tcaaaagcttggaaccttacaacaaaaagctgggaacagacacctggtattatgccaaaagatgcttcctgtccttgttagaaaacatgtcaaaacacacaatcatgcttcgtgatagtgttattcaagaatgtgtccagtttctagaacactgtgaacttcatggcagaaacatacctgctgttattgaacaacccctggaagaagaaagaatgcatgttggaaagaatacagtcacatatgagtctaggcagttaaaagctttgatttatgagattataggatggaatatatagtaatagctgatagtggcatttatcaaatggctttgttatgtaaatttgcatcgctttatttaccctttggcatctttatatttgttacatgttgaactttgtacacttatgcattataaaaaaaaaagtagctaaaacttttgctgttaaatttcccagaaagtgacatattctaagaacttttaccccaggagttatgaaaaattccaaacttatgaggaatgtttatatcagaagttgtaatacgtttgtttcctttcctctgttatcttttgtgctttgacgtatcttgaggggtctttgcacaaggattacatcattcagggaccaagcactatctcagtaatagttaagagtagtctttaaataatcatttcagggattgtgtgagagtagtctcacaatttacactcattaatttgtaatgcatactttttatatagactttaggatattttggcagtgtttattcatatggatataattctttacctaaccaaaattccttaggttataagtggttttaacgtgcaaaagtcagtaaaaaattttgttgccttaacaaaattatggtgctataatgtagagacaatgaacgattatcaaagaacaaatttccctggttttcttttgttccctttaataatttaaatatatgaacaagatacactgttac

SEQ ID NO: 14148 - DNA, 429 bp, Homo sapiens
aattttgttttgctttgtcctatgtttcttcaaatgctggccatttccctttttcccccccaaatattgacttaaccacagtgtcttttgtgatgttttttccttatactcattcattatcttatgcttttagttcattcacccacttttaagatttgtttgttttaaatttggaagaaattttttcttttttattaattttattgagttgtaaaaagtcaataaagaggctgggtgtggtgtttcacatctgtaatcccagcactttgggaggctgagtggggaggatcgcttgagcccagaggtttcagaccagcataggcaacatagtgagaccttgtctctactaaagacggaaaaatcagctaggcacagtggcatgtgcctgtagtcccagctactttctgtcttcaaaaaaaaaaagaaaga

SEQ ID NO: 14149 - DNA, 501 bp, Homo sapiens
ccacagagctgctgcctccactcttcagcttgtgggctggacctacaacttggggcaaagtcagcctcccctctgagggctttgtaggcatggagcaggacagaggccttgcccaggccttccctgaaccaccctggtcctgtgtctgcactgtagattggcctggggaaactgaaggcccagaaatgggacttctctatggaaaccaagcttgggcccccagccttgtggctcctgagtccctggctagtagacttccctactctcaccttctgccctctcgccatgcctaatattaaatttgccctggtttctctacctacactttagaattctgccctgtgagctgccctagaggtgtcctcagccagaagggcatgctcagtcctcacccatcatgccggtcaatgggagcctcccacatcatcccacacttgagatggccaatagtcctgcctgatgagtgtcaccagctactagggccagacttaaatcagaagc

SEQ ID NO: 14150 - DNA, 343 bp, Homo sapiens
tggaagaagatattaaaggggaagggtgttctgaaatctaagacgtatttttttggataagctaaatccagattttaaatcatataaacctggagatctggccaggtgtggtgattcatgcctgtaatcccagcactttgggaggctgaggcagaagaatcgcttgaacctgggaggcggaggctgcagtgagcctagatcgtgccattgcaccccagcctgggcaacaagagccaaactccatctcaaaaaataataataataaaaataaagcaaaccaaaccaaacaaaaaaacctggagagctttacttgctttaccaaaagatcacctcagatttcttc

SEQ ID NO: 14151 - DNA, 437 bp, Homo sapiens
gctgcttgatcttgtttgatattcttcagcactctactttttataacgggtcaatagcagacgggcggtaactgatctccttatttcagagctgaaaacacaaggcactttgcgttgggtgcagttctattctgttatgctactcccgtttgtcagtaggtaaaaacttttcccattccccagaaggcagtacttctatgaatagttgctttagacaagcattcattgttcaaagggtttgattcctcactgagcaaaagctacagcattataaagatgccagttgaaatttttttaagcttgaattttttaaagctagaaaggaaccctcactgttggggaagtcatgaaagaaaaccccttttcacaagccctggaacaagtggattaagagagtaagagtaaaagtgcaaagactgggaacctggctttattcc

SEQ ID NO: 14152 - DNA, 367 bp, Homo sapiens
aaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggtaagacatcttaattgcaatttttaaaatactaagcagtgttcatattatagaatttatttttaaagcttattaaa

SEQ ID NO: 14153 - DNA, 1833 bp, Homo sapiens
aaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctaggctcttcaagcattctatcacagtctcgtagccaggttatggtggtccaagctgatggggcattcacaacttagagctagtcagactttagaggaaacagtactgctggagcaccctttcagtgctgtgaaacaagaactgcagagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgactttcctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtaagta

SEQ ID NO: 14154 - DNA, 1741 bp, Homo sapiens
aaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctagggaaacagtactgctggagcaccctttcagtgctgtgaaacaagaactgcagagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgactttcctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtaagta

SEQ ID NO: 14155 - DNA, 1387 bp, Homo sapiens
tgagcagtgctttcatgtggtctccaggtaacgccctgttagtcttgagacccacaagagtcaaggggctgtttgatggttaggattgtaggagtccttgatgggcatgtggattgctggggattgctcactttccttttcctccaattaggcagcctctgtagactcctagctaatcctgtcaagacaggctgctttgctttcttccttgcttttgatgcttcctgtcatgttgaattccactgttctctgttagatctacgtgaagtatgattgtctactcattattttggttcccctctgtggaagaggtgagcactgaatgtatctagtcagccatcttgaattccctcctgcttagatttttatttttgacaatgatttacgtgattgcttatgactagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgaatacatatatgaattctacgactttcctaagaaggatactggtgtgcaaacagatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtaagta

SEQ ID NO: 14156 - DNA, 1779 bp, Homo sapiens
aaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctaggctcttcaagcattctatcacagtctcgtagccaggttatggtggtccaagctgatggggcattcacaacttagagctagtcagactttagaggaaacagtactgctggagcaccctttcagtgctgtgaaacaagaactgcagagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcagaaagccatcactgcccaggtagaagagaagcgcaggaagaaacaactggaggaagagcaaagaaagaaggaagaacaagaagaggagcttcgcttagcacaggaacgtgaagagatgcagaaacagtatgaagaagacatacttaagcaaaaacaaaaggaagaaatcatgactctcaagacaaatgagctattccagacaatgcagcgagcacaggaactggcacagagactaaaacaagaacaaagaatccgagaattggcgcaaaagggacatgacacttctagactgattaaaaatcttggtgttgatacaatacaaatggaatataatgcatctaacatttcaaattcaagacatgattctgatgaaatcagtggtaaaatgatgacttaaatataggaatattcaccaatgcagaatcacattgtggatcattaatggagagggacatcacaaattgttcatctcctgagatttcggcagaacttattggacagtttagcaccaagaaaaacaagcaagaactaactcaggataaaggagccagcttagaaaaagaaaacaatcggtgtaatgaccagtgtaatcagttcacaagaatagagaaacaaacaaaacacatgaagaaatatcctaaaaggcctgattggaatataaataagccacctaaaaggtatattccagcatcagaaaagtaccctaaacagcttcaaaagcagagagaagaaaaaaaagtaaggaggcagatggaattgcttcatttggtagaaaaaaataatcctgggcacctctctcaaaacagaggcatttcaccagaaatttttcattcatctcatcaagaaacggagtcaaagttgaggtggcatctagtcaaaaaggaagaagagcctctgaatattcattcattcagcaaggaaaggtaagta

SEQ ID NO: 14157 - DNA, 1277 bp, Homo sapiens
aaaataaatctgtcttaaatgaacatcaggagacatctaaacagtgtgagcaaaaaattgccatagagaatgaatggaaaccagctgatatattcagtactctgggggaaagggaatgtgatagaagttcgttggaagcaaaaaaagcccagtggaggaaagagctagatgaacaggttgctttaaagaagaaagaaaaagaagtttctgaaaaatggaatgatccttggaaaaaatctgaaagtgataaaataatatgggaaaaacatcaaattcttgaccaatctaggctcttcaagcattctatcacagtctcgtagccaggttatggtggtccaagctgatggggcattcacaacttagagctagtcagactttagaggaaacagtactgctggagcaccctttcagtgctgtgaaacaagaactgcagagaaaatggattgaagagttgaataagcaaatagaagatgaccgtcaaagaaaaatagaggaaaaaattatatattcaaagggtgaggaacatgacagatgggcaatgcactttgattcattaaagagttatcctggttctcaatctcagctgttctctcagtcaacacacaaacaacctgagtacttctgtgtctctcctgacactcaggagctggctgatgtcagcagtgtttgtacacctacaaccggaagccaggttgaaccttcagaggaggagcatatagcaaaacctattaaggatgtggttatggcaaacagtaagaaaacaaactttctccgttctatgactgctctcttggacccagctcagattgaggaacgagacagacgacgacaaaaacaattagagcatcaggtattgcattgttaaacattgttctttaccttaataagtaacagtcatggtgaacatatacctaagtaaatggaaatttaaattctgatgtaaactttacagcataggtcctgtccagttgtgtcacgaatccaatccctaccacaactggcattgtaatattagaattagcttatcaaatgctacagccacctgccttccagtacagaaggtctttaatatattaagttgtatatgtgaatttgtgttgtcttagggtagtactggtttttttttttttcatcaatttatttctcctgagttgctgtttaagatgagaattcattactttgaatagggattgaactagaattatgagtaagaaatgtaatgcataatggccgggcacggtggctcacgcctgtaatcccagcactttgggaggctg

SEQ ID NO: 14158 - DNA, 482 bp, Homo sapiens
atttttcattcatctcatcaagaaacggagtcaaagttgaggtggcatctagtcaaaaaggtaaagctcttccatcttagatgatgtgttgacgtttctggattcaaaacacagtttctcatacgtatgctttggtaaggctgttctgatctgtttcagtttacattagggatcagcaaactatatcccatgggcaaatccaggctgctgcctgtttttggaaagttttatacgaacatagtcaactcattcttttatgaattgtctgtggctgacttcacacaccagactagcaacagaaacaatatggcccacaaagctgaaaaggtttccttatgcttatcgagtcctttacacttacacaacttctgtagatggatgctgtgtattcaaatacccctttaaaacccttgtttatagtccacatagacagaggtttgggagattaggaactcccaaggattagttttgactctggaaaa

SEQ ID NO: 14159 - DNA, 558 bp, Homo sapiens
cttctgacctcaagcgatcctcccaccttggcctcctgagtagctgggattgtaggtgtgagccactgggcctggctcatatggtattttaaaacagtgttatttttaatttaattatgaccttaactggtctctatttacattctgtgagttgtctcgttatgtcgttaggtgaatgtagaggctccctttagagtcttataaaggagctgtgcaatttttgaaatgaatacaaaactctgccactatgtgtaagtgtttagttatcaaatatacacatatgccaagtgtgtcttgtgtagtgcttttgtgatttttaaattttatctgtggttaattttgggtaaagaaacagtgtcactgtttttctatttatttttacacttctgctagctcttcaagcattctatcacagtctcgtagccaggttatggtggtccaagctgatggggcattcacaacttagagctagtcagactttagaggtaagtcctaagtgtcagtactttggatatttaaaccttttagtatttgacctctaacctattttccttgaag

SEQ ID NO: 14160 - DNA, 1839 bp, Homo sapiens
gcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctac

SEQ ID NO: 14161 - DNA, 626 bp, Homo sapiens
gcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggagggtgttcttcccctgctctccaacttctgctctccacatcgctagggctgtgaaaacagatactgtgagccctgaaccctccaggaggctgcttccccatgacactagtgaccagtaaaatgaaaaggaggagcaaaggagattttgagtcacagaaatgaaacccaggcaaccagcctagaagaaacactccaagatattcattaagtgctttgtttcccgttcctctgacatcttgtaaatgctttttggattaaagatgataacaggctta

SEQ ID NO: 14162 - DNA, 2036 bp, Homo sapiens
gcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgagacttttataggtggacttttgtatagatgttaaaggtaatacgctttgctgtctacagggctgggagactttctggaagttcttgggaaaactaatcaagcctctgtacatacaattggtttaaattattttttcacttgccctggaaagcaaacaaatgagtaataaaataatatgtgtgaaattggca

SEQ ID NO: 14163 - DNA, 1658 bp, Homo sapiens
ccctgagcagtgttctgggcttgggctccggaaccacactgcagcaatgctttgctcggttaacgagatgacactggaaaaaaggccttggtgttagctacagtgagctggactctggatcgtctgggcagattattcctatgcatcctgccttcctcacccaggactggtctgagagggattcatgatggaagcatgttcattctgtgacctggttctcgcctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgagacttttataggtggacttttgtatagatgttaaaggtaatacgctttgctgtctacagggctgggagactttctggaagttcttgggaaaactaatcaagcctctgtacatacaattggtttaaattattttttcacttgccctggaaagcaaacaaatgagtaataaaataatatgtgtgaaattggca

SEQ ID NO: 14164 - DNA, 523 bp, Homo sapiens
ccttagccacttggcactatgcaaagtgctttacatatgaggatgaaataatttaataaataaacacaaccgtggaggtagtgagtatggttctccatgtgcagatgaagagactgagggtcagagtgacagtgtgatttgcccatggctacatagcttggagtggccaggccaggctcatcccagagccctgttcctaaccactctgttcagttgcactcacgtgccagaaatgtcttgtgtatttctacctcacttatcaggaaccatcagaaaatccagtatagaacacgttctgtgaaggagaacgtaaagcctctgtgctcaaagaactttgagggtgtttgtggaggtgtggacagcctccaggagtgtcccagccatcacagatcacatccgacaccaggctgttaggccggtgcccagaccacacatccatggcagagctaacggggagaggcttccgatcgagtcctgtgtttatttttatgcttctgcagagcattctcacaccagtcaccac

SEQ ID NO: 14165 - DNA, 857 bp, Homo sapiens
atttgcccacctccttctgatcattttattttcttggcctgctctggcaggcattcaacaaacatttgttgtgtgctgtgtgccagtcactttctaggcacgtgagacagcagtggataaaacaaagatccctgtcctcttggggttttacgttctgctaggttgacacccagaatagattataaacacagtaagcaaattgtaccttagaagttgatcagtgctcttcaaaaggcgaggaatagagcccgatctggggatctggaatgatggcagtgcaggtaggaatttttaaatcggaaaggcttcatggagatgactttgaagcaagcacctggaagaagtgagagaatgaggcacgtggatgtgggccagcagcattccaggcaaagggaaccacagcaaatgcaaaacccctgaggctggattgtgcccgtttcactcaaacagctagaaagagcgctagtatggtggcagtgagtcaggggaagaagaggaagagatgaggtcagagaagtgatgagcctgttctatgccaaggcgaggacttttatctttgtcaaatatttccactcccatcatggcccgggaaatctcactaatgtaaaccttactgaaaatcctaactgctgtgatcaaggctgccataaagggaagcccggaagaggcggggaggctgccttggaacagggtagtgtaaggatgtgccagaaggcctgctggaggttgcagccctttgagctggacttggggatagtgtggttttccaggcagaaggaagtgaaggattaggtcggcctggtagtacttggcacacaacatgcgcccaataaataaaatggaaataaaaccgcgga

SEQ ID NO: 14166 - DNA, 369 bp, Homo sapiens
ttatagccactacacacagtaaagtgagaagattatacatcttctctcaatggaggatgaataaactattagtagtttattgagtacattcctttttgtgtatacctgggatgtatacacacaaaaaaggaagaatgataggaaacatgtaaagtatattagaaataactatgttttattttgtgatcatggagaaatatgggttcactttaatattgaattgaaaaaataaaaatgtgattagaaatttttgtatttaatgagtcattagatatgattataaatttttcaaaaagcattatacagttctccaatgttatataccaggcagcactgtgagtgttctcaaaggcattgctcagtctccac

SEQ ID NO: 14167 - DNA, 398 bp, Homo sapiens
gaaaatggatcaccatagactattcagtagtagtgttactatgccgaattccaaaaaatcagtgatccaaaatcacttaaaagactatcacccaagttatatgttacagccaaattactgcccaataccacctgctcctgaggaaggctcctttgccaacagcacagaccaggagccaaccaggccccagcacgctggaggagacgttcgtgcagcccgctgctatttgagaaaagcactgacgagctgacagggcaagccaaggacctggaggccactgtgagggagcctgcagccagcggagatgtgcagggtccaggatgctctttgagacgaggccgctggaccgcctgggctcccgccctccctgcaggagcagagcccttggaactgcgcta

SEQ ID NO: 14168 - DNA, 200 bp, Homo sapiens
tgatccctgtcaaagctaaagtggcctggtcagtgagaacccctgtgaggagctcagaggaggaagcccttaagatctccagaggcatgagttctgaaagacagtgtggcctgtatatgctgaggggactagtaacagaagagaggaagtaagaacaggcacggcacgctctgctgaaagtagactgcggccaggctttt

SEQ ID NO: 14169 - DNA, 390 bp, Homo sapiens
attaattgaaaaacagtaggttttaatctttccctctgcttctttgatagtgttgaagattagagcaggttatggagataataccaaaaagctctattaggtaatatagtacagttttccttctatatccacagatccactcaaccactgatcaaaaatatttggaaaaataacaatgaaaataacaatgcaacaataaaaatagaaataagaaacaatacagtataacaactatttatatagtatttacattgcatgaggtattgtaaataactagagattatttaaagcaggggtatccaatcttttagcttccctggcccacattgaaagaagaattgtctttggccacaaataaaatatactaacactaatgatagttgatgagct

SEQ ID NO: 14170 - DNA, 683 bp, Homo sapiens
tgataaccttgggtttgaatcatggtactaccacttagtagtttggtaatttggtgcatgttaaccaccctgacttccactcctctccaaagcctcagagatctcatagggttgtttgagggttcaatgaaatatatgtaacatgcttattgggatgtctggttgataagttcctcgtacaaagtggctgttattgttaccacttttgttgttgttcattcattctttcaacaaatatttattggcttcctgcaacgagctaaatctgtctagtcactgggtatacaacactaaacaaaacagacaaaagtgcttaccctatgaaatattctagttgttaagagaaagaaaataataaatgaactctgcagtgtgtcctatagcattaaatcttggagagaggctaggcacagtggctcatacctgtaatcctggcactttgggaggctgaggaaggaggatcacttgcgttcaggagtttgagaccagtctgggcaacatagtgagaccccatatctttaaaaaaaaaaaaagcctgctgtgggcgagcgtgtgtagtccatttgctcaggaggctgaggcgggaggatcatttgagcccaccaggttgacactgcagtgaaccatggttgtgccactgcactccagcctggatgacagagtgattgagactctgtctttta

SEQ ID NO: 14171 - DNA, 1478 bp, Homo sapiens
aaagctacctcactagcttttgtgaaagtcaggctggaaagtgcttccagccacagaaataggctgtgggtgtaaatattaaccttggccatcaaataagtaggcatagagtgtgactcgccctctcttggtcttccctgaaacagcagggtcaagaactcctggtctgtgttagccacgtggcttacaaaaacaatgacacagaagagggaaaggtgggactagccaagtggaaggccagccgtttatctctcagtgtcctgtgtcttatatcctgagcagagcaaggtgcaagaccctggactgggcatccagcagaaacttccgagaaacttgactgtgaggaaggatgcttgcctagcaattggtcggatgaagggctccatttgatacttccttcactgtggaaggaagaaatttgtaaaaattatttccagaatatgcacacattaaaggtttataaacctgacctttctttagtagaagacagtaagagaatactgttggctctgggaactaaccatttgagctgtgggacccagggaatctctcttgtaagcatcatctttagtgggtgactcctggtggccctcccagctctggtggtgctgtggggacctgccttggagatgccttggtactagtaccttttttgtaccaggccatgagcctagggcacagggcctctggcctgccagatttcaggaaggcagctgtgttgtgtgaaccgatacagcctgccagcacttctgtcccgagtgactgtcgttgtcatcgttagcatgttgcctgaaaagccttggggtcttgggcgctgacactgaagctttttttttcccttctggctctgtgatgtccagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14172 - DNA, 865 bp, Homo sapiens
  misc_feature (809)..(809): n is a, c, g, or t
  misc_feature (843)..(843): n is a, c, g, or t
  misc_feature (858)..(858): n is a, c, g, or t
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagaacccttcccttggagccccgaaaaatgaggaaaattcttcgacatttttggggggggaaaccttgnaaaatcttgagccccgttaaaaagaaagaaaagnttcccaacttggaancaagccc

SEQ ID NO: 14173 - DNA, 1006 bp, Homo sapiens
aaagctacctcactagcttttgtgaaagtcaggctggaaagtgcttccagccacagaaataggctgtgggtgtaaatattaaccttggccatcaaataagtaggcatagagtgtgactcgccctctcttggtcttccctgaaacagcagggtcaagaactcctggtctgtgttagccacgtggcttacaaaaacaatgacacagaagagggaaaggtgggactagccaagtggaaggccagccgtttatctctcagtgtcctgtgtcttatatcctgagcagagcaaggtgcaagaccctggactgggcatccagcagaaacttccgagaaacttgactgtgaggaaggatgcttgcctagcaattggtcggatgaagggctccatttgatacttccttcactgtggaaggaagaaatttgtaaaaattatttccagaatatgcacacattaaaggtttataaacctgacctttctttagtagaagacagtaagagaatactgttggctctgggaactaaccatttgagctgtgggacccagggaatctctcttgtaagcatcatctttagtgggtgactcctggtggccctcccagctctggtggtgctgtggggacctgccttggagatgccttggtactagtaccttttttgtaccaggccatgagcctagggcacagggcctctggcctgccagatttcaggaaggcagctgtgttgtgtgaaccgatacagcctgccagcacttctgtcccgagtgactgtcgttgtcatcgttagcatgttgcctgaaaagccttggggtcttgggcgctgacactgaagctttttttttcccttctggctctgtgatgtccagcattacccagaacgccatggaggaccagagcgccacggccgggactcccgcgatggctggggggtatgtctaaaaagataacaggccggggttccccccccagttggtcccaccaagaccgaccccccccccaaagggccaatcgt

SEQ ID NO: 14174 - DNA, 1911 bp, Homo sapiens
agaactaaatttcgggtaggtatgcaacctcagcacgaattttatggttttgagtttgtttcctccatgctgcttccttgtggagtgacattgtcttttgtctctagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14175 - DNA, 1335 bp, Homo sapiens
tggatcgagctcggtcgcctcgcgacgtgttatccattactacagatcagaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14176 - DNA, 1808 bp, Homo sapiens
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14177 - DNA, 1132 bp, Homo sapiens
aaaaaaaaaaaaaaaaaaaaaaaaaaagcctcgtgccgaattcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14178 - DNA, 1759 bp, Homo sapiens
aattaggctaggtacgaggctggttgtaattcggccgagggtggacagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14179 - DNA, 1365 bp, Homo sapiens
caggatccttacactgctcatcaaatagcgacacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14180 - DNA, 688 bp, Homo sapiens
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctatacaaatgtaatgaatgtggcagggtcttctggcactattctcacattgtactatattgcaaaaatcacgt

SEQ ID NO: 14181 - DNA, 473 bp, Homo sapiens
caggcatggggtactgtggaggctgctgccactcaggaggggagggcattaggaaggggccctgcctgcaggcaacactcagggaagctgtgcaggctgggatgggccggggagcaggaggacttcgcagtcaaaccaatgtgaatttgttcctaggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacatacccttta

SEQ ID NO: 14182 - DNA, 3075 bp, Homo sapiens
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14183 - DNA, 3080 bp, Homo sapiens
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggataaccccaacaaaactttccaatgtccccgaagagatccgggtgttgggcgataacatca

SEQ ID NO: 14184 - DNA, 2972 bp, Homo sapiens
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14185 - DNA, 1402 bp, Homo sapiens
ccaccgcgcccggcctgttgcttatttttgactggctgtttcctgaaatcacttgtcaagctccaggaaatgttggagaaaggaggcccagttctgatcacacacacacagcctgggcctcactcctgagatcttcctgggctgctcctgtgggcccgagaagccttcttcccgctggagtgtacggttctgcagaccacgtagtggacgcacagccctggagtctgtgcgacccagcgtcttacttaaagtcagccctgggacctggctgggggtgtctaggtccccttctgcagctctactgttgtgcagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaatca

SEQ ID NO: 14186 - DNA, 2848 bp, Homo sapiens
agaagcgaggcgcgctggggcgactggagcggttccctcgcaggcggcgccattttgtgctaggagcctgataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccaggggcagacgtgactggggggaccatggccgaagagaggatgaccggtcatggcagggcacggccgacgggggcatgatggacagggatcacaagaggtggcaaggtggcgagtgtggccatgactggccgagtgactaaggaggggtaatcactgaacaggccaagcgttttggttacacacaggtttctgttgtggtaacactggatgagaatgaaattgagcaaggaagcttccgtgctccttacatgtgactaaaacaccaagtcagcc

SEQ ID NO: 14187 - DNA, 185 bp, Homo sapiens
gctcccacaaaggtgatagatacatttggggtgggggatccctctatctctgtctcatgtcccctcacaggcgagatgatgcctattggccggaagccaagcgggccgccctggatgagcgctaccattctgactttaaccgccaggaccgcttccacgactttgaccacagggaccgcggccgc

SEQ ID NO: 14188 - DNA, 347 bp, Homo sapiens
gcggtccatatgccttgatttattcaaatagctactatctggaaactcactcccaacctttgggccactgtggtgaagaggcagctgtcccagtggggtactgagcacccacctcctcccttcccttgaatgtgttgaaagtggactctggccaaacgaggaaagatgtctcagaaaaacaccaccacaccagggagattagaagaagagaagggcatttgcctcccatccctgacccccttgactggggctgattattatgggatgacaccatgtgtacaggttgtaggtctttcacagagaacccatcatttggagctacagacttttccctttctaggttactt

SEQ ID NO: 14189 - DNA, 371 bp, Homo sapiens
ttgaggctgtagttggccatgactatgccactgcactttacactgggcaacagaaccagactctgtctctaaaaaaaaaaaattacaccctatagagacaacattaagacacagaaagaattggtgggaagctggatacaacggtgagcactgaaatcagcagaacataaatctattgattcaaacacatctgaactaaaattataatcagctacaatttaagcatgtgtgtgatgcaaatagatgagaatcataaaaaatgaaggtataaagaaacatctttcacttgggaaaagagaaaatgcaactgtttagactttgttttaaagggaaacgttcagtgtgcctgtgaacaacttaaagacaatcaa

SEQ ID NO: 14190 - DNA, 339 bp, Homo sapiens
aacagacgcgtgcctgttatttttgcagtgatttctgatctgcatactgaagagtctgtacttatgcattcataggtaacacaccatggtgactgaaatttgaatcctgggtgactagtgttgttatctaatggtaactgaaatcagtgcacaccagaaccctgcaaagcaaggactggctctacagcattcccttaaaaaacattttttttaaaagtgtcctggacaggcacagtagctcatgtctaaaaacccagcactttgggaggctaaggcgggaggacttcttgaagccagaagttcaagaccagcctgggcataatgagacccccgtcacta

SEQ ID NO: 14191 - DNA, 195 bp, Homo sapiens
aggaggctcaacttctcggtgacctttttttgcttcacaacaagccaattatagttgaatcattttctctcttagctagttgttactacaaactttataagaaaaacaactagacaccttctagttttaattaataccaactcctttagagttagagactttttaaaaagaatcattgagcatattttctttttt

SEQ ID NO: 14192 - DNA, 221 bp, Homo sapiens
taagtagtggtaaacctactattggttgaatcgtgggtgtcccactaagcgtgacaccgttgttccctcatggccacataagaaatagcctcccaagttcctgggacacctcatgcacttctccctggcttattcccacttccctctagaagccaacagtcttctgaattgcgggtcagccattcgctggcttttgtcggtttcccacctttgtctggatc

SEQ ID NO: 14193 - DNA, 464 bp, Homo sapiens
acgatcttcagtgggcaccgctgcagacacatgcattccacaaaccctgcagatccgctgatcggaggcattgattcctcaaagcacatggccctgaaattatacctaaaaacgcaaattccccgggcccctaccccagacgcactgaaacagaagccgtgagggaggggcccgcagcttgtcagtcatcgcgaggtgattctgttgcactcttgactttcagaaccactcaggagattacacactttggaaaaaaaaagaattgtttttctgataggactttcttaaatagcagaccctatgagtctgtttacatttgaatttataaggattcaggttatatatatcacttcaaaaatatctattatggaaaaataggaattttttaaaaataaaattattctcaagaccagcctggccaacatggtgaaacctcatctctataaaaatacgaaaaaaaaaaa

SEQ ID NO: 14194 - DNA, 467 bp, Homo sapiens
agttacctttttctgtattgcatttctaagacagagatgactcagacatcaaaatatatatgaaaggtttgtgtatcaggctttggaacaaggatggttgaggatttcagccctgcattctgtatattgaaacaaaaactccaagcagagactcttccatatcccctggcaaccactgttatgctgtcattataaattagtttgcttcttctagagttttatataaatgaatgtgtatacatcccccgcccccacacacacacatgtagtttctgtcactcagcataattaatttgggatttatccatgttattgtgtatatcaatatatcattactttttaattactgagtaatatttcactgtttggatctacaacaatttgtttactaccatccaaatgatgatagacatttgaattgtttctgtttcttaggtattataaataaagctgctttgatcatttgc

SEQ ID NO: 14195 - DNA, 204 bp, Homo sapiens
ttaatgtacaaggttctatacaaatgcaagggaattaatgtataacatatatgtggggctaagtctctaaaacaacataataaaagttgtttttattttagtcaatcatttaggtattgtgtctacctgatagcatgtaacaagattgaacacttgtgtaggtcgtatgtgcctttaatctgaggttggcctcagtgacaatca

SEQ ID NO: 14196 - DNA, 246 bp, Homo sapiens
taacagcttcggatctcatatcccaaaaatgcctttgaagacaggatgatgttggcagtcttgctgtgtcatttctgaagtttactccaaaaaatgaaattctccagtgacaggcatgcttaagtgcagctgtggatactgcatgttttgataaagatgaaatttattaaaaagcaaaagaacctccactaaacacccctcttcccattgacgctgggaggggtaaagaaggcttcttgggtttaa

SEQ ID NO: 14197 - DNA, 552 bp, Homo sapiens
gacgaggtttcaccgtgttagccaggatggtctcaatctcctgacctcgtgatccacccgcctcggccttccaaagtgctgggattacaggcgtgagccaccgcgcccggccactatttttctaaatcttactttttctggcttgatttgaagccaccttgctaagctactgtattgtattatactaatcataggtagctctttttttaagatgataaagtggttcctgagtattgctacaatcccagtttcccataagaaactctacaaaacttaagacttttagctttgccaggtctctctctctctgaagctgtaatttttagaaggaacgattgcttgaatgattaatcacactcttagttacaccagtaaggccataattaactgttggcgcctctagcaaaaagtgcaagtggctaatggtctcaaccaataattcttcccctttttcatctatttatagggaacgatttgaggctgaagatttgactatttatttcaataaagcacattcatttgtgcttgtctcagtgtcatacataatggttt

SEQ ID NO: 14198 - DNA, 408 bp, Homo sapiens
aagcttgcactgaactgtttccttctcagctctgcaccctagccatccagttctgccccaccggagataggcagaatttcctgtctcttctatatctgttcagaagtattctggaagataacagtgaagagatagagatgtaggtgtagatgtagttatattgtatttttacttatttttcataattaatgtcagtcaccctttcagacctttcagacactaaccttctgaacactaacctcttgaatattaactaacatatattagaggaggaaggatgtctgtcagatgatcaaaatgtctcgaagcaaaatgagcattttgattggtgacagtgtgatgttataacaggcagtaaaagtaggataagtagaggtcttaaggcagacagtaacagatcacattcag

SEQ ID NO: 14199 - DNA, 1686 bp, Homo sapiens
tctaagaagatagatactcctcatagaacttatcacaatgaaaactgatcatttgtgtgattatatatgtattcctcctctttaagtctaaaaactctattgggatatggaacctatctcaatatgcatcatcttaaccaaggcatctaactgtactgcctgtcatgtagtaggtactaacaaatgtttattgaatccatgaatgaatgaatctttaatgtttcagtttaaaaatacatattaaacgtataacatatacaaagcacaatttgaaggcactgggattacaaaatataataagataatccctacttgtgtgggaagttccctgaattctgatgggactaggatgggacacttccagttatgtcaggctgctgaagccatagcctgccctgccaacaggcaccatgaaagagctgagcctcagcagccatgttaggtatcatgtgactctgtgccttgaccacatttgaatggactgaggtgaaagagtatgaaagcaggaactggcggcatcctatcatctgagctttagcaagaagatgtggaccctgacaaatcagattcctgtgcttgggtatttaaataaaaatactaaatgactgaattagaagtgtaaagagaagttgcaaagatactgtagtggtttgaatggtggccccccaaaagacatccacccagtacctgtgaatgtgacctaatttgaaaaatgtctttgtactggtaattaagtgaaagatttaaagatgagatcatcctgaattaagtgggtggtcataaatccaatgagcgtgtctttatgcaatagacagaaaggtagaggacacacaggagaggttcatgtgaatgaaggcacagacagacagtgcacatatgtagccacaaaccaacggaggcctggagcaaccagaggctggaagaaggaaggaaggatcctcccctggagacttcagagggagtgtggtcctgccgacaccttgatttttgaacttctggctttcagaactgtcagagaatatgtttctgtttctttcaggccccacactttgttacggagccttaggaaactaatataaatacctagaaagaagaaatatataggagtaaaagtcatgaacggcagcttgcaaccactgatgttacattgaacaaggaactgaataaacaaaaagctttgcagtagggaaataacacagtctggaggaaaatactgagccagtcagtggtaaaagacacatagaattggatcatagagagcagccacgtcacttctctggttaagttctggtgtaaagatacacagattcctgctcttgataatcctgctgctttggaagaagcttttatttcctgcttatccattaagaagtcaggcatgtttggggtttatatttgtttaatcttacaggaaacttcccatcatttccctaaggctgaaacattttgtaaagaattgtaaatagaaaattgcaatataaaacagaaagtagtaaacaagtccagcatgccaatgaactaatggactccaaacaggaacacttggtctggctagaaatttcatgaaaagcttcctggatgaattcattaaattatccctggcatatcttgaaagtggagtgggtacttttcaactgactaataagagatgaaaggacaagaaagaaaaattttcaaaaaaaaaaa

SEQ ID NO: 14200 - DNA, 900 bp, Homo sapiens
acatgtcttcctatttttactactagatttttagcaactagagatagggaagtttctaataccactttatctgccagcatgccctacatgtactccacagaacaggaatcaaaactactttctgtgttccatttaggggaatgtttagagacaggccaattctagtacttacatgaaagttctctgaaaactgtgaaatattaagcagttgtaaggcagtagtagaagtggtaatagcagctgcagcagtaacataagcataaaacatgtttcctacttcagggatcacatggaatataaaatatatacacaaataactttaccatgacacagactatattaaatgctataagtacaaagaggaggcccaaatagccaagaatttaaaaaaaaaaagcaacttcagtaataatcagaaaaatacaacttaaaatgagattactataacacagattatcactgccagaaaggcttaaaatgggacttagaggataggaaggcctttaacaggcagacatggtgaggctgggcattctaaacatacaggaccaggtaagcagactcagaagcaggaacaaacatagtgagcatgcaggtgtgttgagtccaggttggctggaatataatctatctgaacgcaagagagaagcccgaactaagaagactgaagaggccagatcacagatctcgtaagccaaactaagaagtttggtctttactcaggacacaatggagaacgactaaaaatcaaagttgtgttttcagatgattaacctgggttttaattatttaggattatgccagaactttgggaaaagcttgaaggagggaaacatcagttatgatagttaagacaacttaaaagtttgacaaggtctaagaaaggaaaatggcagccag

SEQ ID NO: 14201 - DNA, 205 bp, Homo sapiens
acacttttattagatatataaaacctatgtaatgatcatattttctgagattattactctagattcatgggcagtaatagataaatgataccaggagtggggtggtggcaggaggacctggagagtaggggttgggtggcaggtgtatgtggttaacaaaggtcaagatatagaaatctgtgggtacagagtgaacagagagggt

SEQ ID NO: 14202 - DNA, 263 bp, Homo sapiens
atccaaaagggtattttatttgccttcagaccctacttttacttcattgccacttaactaaaaagtaattcctaaaatttgtgatttgtccatattaattgaggagccagcccagatatgggtagagatcaccttatgatttattgtttaactttttaagtttgttgtactgcccagaacccccccatgtaaattaataataataatgaaaaataacagcagtattgttttctgtttttaaataaacataccagtatggaaaa

SEQ ID NO: 14203 - DNA, 546 bp, Homo sapiens
atatagtagaggaaatacaaccattatgacccaataatgctcttctctgaagaaagccaaatttggggacagagctaaaaaaatgtaaactcagcctcaataccttgggttagagatagaaatgtccctctgttcacacaaaaattaactgacctagatatggcaatgcaacattagacttttgaatttctctctttgccaacctttgttaaatatttcatcagtgttgacacccactgtgtgtcaggaaagagaccatatgctattggaaaggcaaagataaatgaagacatgttttccgcccttggggtagctggagtagaggaacgggaatcggctttttaatccaacattcctcgggtccagtccaagtgccaccagtgactggctgagtggtgagtgccttgtcctccttaaactccaagatctcatctctaaaatgaaaaaaataataacagtccattaggttttataaaaattaaaccagatactctctaaatgagctggcaaatagtaagctctcaaaaaaaggtaaccatcctcatt

SEQ ID NO: 14204 - DNA, 349 bp, Homo sapiens
agagcttttatattcattgccctaaattgtctaattaattcgtgggtgctaaagtacctgggctgagattttagagttcagtggaatccataagcacagaataccccagctccagattacttaaaaaaaaaaaaactactcacttgatatcccttgttccacaccttaacataaaccccaatcccttacaatttagctgccctatatctccttacctcgggactttactctttgcaaagtcatagctaactaacctgatcaattctattctttcaaactagaagtctcaggattgcctgtgctttccccccattctttcctgtcacatctaatcactagactctcttga

SEQ ID NO: 14205 - DNA, 542 bp, Homo sapiens
agcagtgagagcatgtaccgtgtaatgtgtaaaggggagggagaatgtgaggtgctgggaagcaccgggcccttcgggggacgggaagaatttgggtgtggccagagcacagtgccccatgagtggagaggtccagattgtctatttttcttttcttttttttcccccaatgatcctagaaattctcccaagagaggtccagattttttgacaaggctgaagggcggcccctgagacctgactctacctgtctgcctggcctttcctcagtccagtgcgtgcacggccccctcctcgctctcacgcatcatctgtgtgctccttccctgccagacaagaacccctggagggcagggaccagttcagagccatccctgtctccccagtgccagcacagagcttggcctgagtaggttttggggactgggcttggtggctcacacctgtaatcccaacattttgggaggctggggcaggaggatcacctgagcccaggagttcaagaccaacctgtacaacatactgagacccggtctctacat

SEQ ID NO: 14206 - DNA, 1157 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcta

SEQ ID NO: 14207 - DNA, 945 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaagttggagtgcaatgacgcgatctcggttcactgcaacctctgcctcccaggttcaagcgattctcttgcctcagcctcccaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagccccaccctcttgtggggggcttcctggcttcacgagactacgtggcagaactgggacagtggttgccggggtgaaaggcgggttgggagcagccggggtcccgggcgagggggagtaaggcatgcccaacagttggggcgacgcactctgcaaggcgaaggagacacgtgtgggggcgggttacgcgcgccacagaggacccgagagagctaggtttcaaaaaggactgcggcgctctccaaacgcgttcg

SEQ ID NO: 14208 - DNA, 757 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagagtgagtagctgggctcaggagagaaaggggatgagatggggctagggtgagtatggccaagactgtgaccgaggtggtcattgtattcaaaatagatttgcatgtatctgcatattccaaaatgcagcaggagggacagctttccgttaatctgggtgacctgaagaactaaaatccctctactctgaggattcgaaaggcagtgaaatgaggctgtatctagggaagcttgcccttagagcacacaagcgccccagttagctggtgttttctagaaaggagcttccttcccaggcggcccctgcatctgccctgaggccctcaggtggtgagatcctggggctggggctttcttactctgggtaactctgagaattgtgttttcctgggtcctgacaaatattttctgtgagtg

SEQ ID NO: 14209 - DNA, 711 bp, Homo sapiens
tgagaaaagagctctgtagcagcagggactgggccaagacttcttgaccccagagtgaaggatgttaggagtggctgagagtccacggcccagagcctcctgtggtctaggctgggggaagggggtgcctgtcctggcctgggggtctctgagcagcccctcctgtctgcctgccccacagccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctctaaaaaaaaaaaaaaaaaaaaaaaaaaaaaaaaaaaaaaaacaaaaaaaaaaaaaaaaaaaaaaaaaaaaaaagagaagacaacacgaaaaagaaaccacacacacaaagaaaagaagacaagcagagaagagaacgagaagagaagaaagaagaagacgaaacgaaaagaggaggccacgcagagaaaacaaacgagagagggagcagagagaaggagaaaggaaagagagggagcgcgcacgcgagaacaagaaacagagagcagaaagaaagagcgaaaacaaataaaagaaaaagaaaagagcggagggaaagaaagaaaataaaga

SEQ ID NO: 14210 - DNA, 224 bp, Homo sapiens
ggtcttagctgagaaggagcatcccacccggcaaggtgtggcccctcttccccacatccccaacaggtactgcgcccctggctgcatccagccttttcctccttttgtctgcaggtatgaggtagatgacatcgatgaagaaggcaaagagtgagtgtccaggccagggcagggcatggagcctgggggcagcctaacagctgagaaggagcatccccacccgg

SEQ ID NO: 14211 - DNA, 1471 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctctaaaaccaacacactaagacaacagaacccgcagccacacatcacaggacagtcaccacctgacacaacgcaccccgctcgaacgccgccttctgagcacacgccccctacgtctagctcagcatctcgacgaaagaacgttatgagttcatgaacgaaagactggcgggccggtatgattattctctcctcggcggcggcgcctcattattaacctacacgaagttatcgtagaagttgctctcctagcggggtcattatctaatacacggccggtgtggtttgtcacgcctgcgtgatccacaccgccccctat

SEQ ID NO: 14212 - DNA, 1227 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagtgagggcagcagctgcgagggaggggctggtgcccaggggctgggactgaccctttgttccactcacaggcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcta

SEQ ID NO: 14213 - DNA, 1052 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaatgaggccttgttccagaaggagcagctcgtgctggccctgtatccccagactacctgcttctaccgcgccctgatccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcta

SEQ ID NO: 14214 - DNA, 458 bp, Homo sapiens
ctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggtaaaaagtcaccaccctccattcccagatgggaacatgggctttgatgctgagccgtgaagtgggggtggcatttgtgttcagagagattggactcgcaggaaccaaaatgacgtaataaaagtgaaaggaggggaatttggtgtatggctaccacctgtggaagtagagatcactctagagtcacgtagc

SEQ ID NO: 14215 - DNA, 431 bp, Homo sapiens
cgctttcaagttttatttatttatttatttattgcattttgttttaaatagagtctggggaaatgggagaaaacgctgaaaacgcacaagcactttggttggttaaattagggttccgccaagagccggagcggtgtgccaagtgaaaactacatttcccacggggcagcgggtcacgtcacagaggaacgactacgcatgcgtgcaaggtcctccgcgcgcgactacgctcataaaaggaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtaggtggcgacgggccgtggcctgagacctccggcgaaacgc

SEQ ID NO: 14216 - DNA, 516 bp, Homo sapiens
  misc_feature (4)..(4): n is a, c, g, or t
  misc_feature (27)..(27): n is a, c, g, or t
  misc_feature (45)..(45): n is a, c, g, or t
  misc_feature (60)..(60): n is a, c, g, or t
cccnagcagccagcaaagaaacccccngcccccccaggacccagncccccccggaccccntgggggggccaagggccctttaaaaggggcattccaggcccagccttcagagtgacctgctcccaatgcagcatgtgtccttcccccaaaatagagtatcattattttaaaatacttggtatgaaaaaatttgatgggattcaaatcccattcacattttgcccaaggatttttaatagtacattcatcaacaaaaagtaagctgtactatatcctttaaatataatttcagctgttgtataatttaaaatggctgtaaaaatgacttaaatgtttatatcctacttgtgcagatagtatttctgattgatgtcatctatcaagaatttcaagagattatctcttttttgtcttgaatcgtgggtagtcatttaagtatacaatctgatttcaaaaaagttatggctacagaaacaagcttaagtttctcaataaagttgtttggaaaatatttta

SEQ ID NO: 14217 - DNA, 461 bp, Homo sapiens
catgatcacacttgtattttgaagtaaaataccctgatcaagtaatttaccaagaagctactttttgtgacacagctccgtctccctgacccgcggttcccagacttcacccattacacccagtctattccccattctggaaagggagaggtatcagcctcttagggggcagagattagcaaattgaaaaatagcagtgaaccagatggaaggctctcgatctttagaggttattaatcagtgtttgttcgttcaatttttaaccagtcaccttgctgttaagagcagaacataattggctggaatgtaatgtagggaatttttccctgttggatccctagcacctagaaaagttcctagcacctattaggtgttaataaatgattgttgaatgaatcagtgattacaagtacttttaagaattttgaaaataaaggaaccattggaaatacaaaaaaaaa

SEQ ID NO: 14218 - DNA, 361 bp, Homo sapiens
caactaggatatcccctatgggacctaccccttttgggatgggtggcactatgattatttactagaactgaggcaaacctggagttaataggctatctagtaccaaaaaggagtcagtaacctaacgggaaagaagaaaatcaacaggtaaaatataaagaatctctagggagccatatccaatgaaaaacaaaaccagccagacagagaatagtggaatgtataatcattcgatgcaaagacagacacacatccataagcaacaacagcaaacggggagccatggcatcccacaaatggacaaagcaaggaaccagtgactgatcctaacaggaagacgatatgtgaactctctgaccaa

SEQ ID NO: 14219 - DNA, 468 bp, Homo sapiens
gcaagtttaaagtctctagtccaggaatggaggtgggggtatgggcacctggcagtgcccacagcaagccttgactgtgtggcctggagatggggcctgagcttcagggtcactgaggcacctctgggatccaggccacctggagccccggacctcccagactccactcacccattccctctccccgcacggcactcacaccaggggcggcctggagcccggatcgcagggcggggccaggccactgcctgccttcctcctccctcccggctggcctgcccccttgcctgcctgcatgcaggcttccagcagagccagcttcttcagagccaggtggatcctgtttcggtcctgcctaggtgtgtgaccctgggcgaatctacctctctcagcttctgcttcccactttatgaaaatgggactgatgtcacagggttgttatgagattaaaagatatgaagaaccggg

SEQ ID NO: 14220 - DNA, 182 bp, Homo sapiens
actagaatgcaaaacacgtgtttttgtaaaacgaatattaatggcataactcgtgctttattattttagctgatttgtatcaatgtatcaacattccaaagaaaatagggagcatatgttggttaataatttttgttatgactattgacatgtaattcacatgacataaactttaccatttt

SEQ ID NO: 14221 - DNA, 244 bp, Homo sapiens
gaaaaatgccaactaaacatgaaactattgatcaatacttatatacctttaatttttcctatttgaaaagccaaccacttaacacattactcatagcacctaagacagtgccttgcatagtgtagtcatctattattattgtttaattagaatattaaaccctaccctttaactcagcagtccccaaccttttttgcatcagggaccatttttgtggaagacaatttttccatgggggaagaag

SEQ ID NO: 14222 - DNA, 3992 bp, Homo sapiens
  misc_feature (110)..(110): n is a, c, g, or t
gtcactgagaagatggatgtgctgggcaccgtgggaagctgtggggcccccaacttccggcaggtgcagggtgggctcactgtgttcggcatgggacagcccagcctctnagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggactttgaccagctgctggaggccctgcgggccgccctctccaaggacccaggcactggcttcgtgttcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaggaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttcttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtgaaaaaaaatgg

SEQ ID NO: 14223 - DNA, 2432 bp, Homo sapiens
acacgggaccgtaggcagagacactagtgaatgggcgtcatggtctcgctgacagtgtccagcgcgcggcgtccacctccttgcatcacacggagcgcatcgggtagcagctgcctcagcggccagggccgtaccacaactgcgatggtggtggctgtcctggccttctggcacatccaaggcttccccgaggtgggtgaggaggagctcgtgagtgtgcctgatgccaagttcactaagggtgaatttcaggtagtaatgaaggtggtgcagctgctacccgatgggcaccgtgtgaagaaggaggtggacgcagcgctggacactgtcagcgagaccatgacgcccatgcactaccacctgcgggagatcatcatctgcacctaccgccaggcgaaggcagcgaaagaggcgcaggaaatgcggaggctgcagctgcggagcctgcagtacttggagcgctatgtctgcctgattctcttcaacgcgtacctccacctggagaaggccgactcctggcagaggcccttcagcacctggatgcaggaggtggcatcgaaggctggcatctacgagatccttaacgagctgggcttccccgagctggagagcggggaggaccagcccttctccaggctgcgctaccggtggcaggagcagagctgcagcctcgagccctctgcccccgaggacttgctgtagggggccttactccctgtccccccacccacagggccccacgcaggcctggggtgtctgaggtgctcttggctgggagcggccctgaggggtgctggccttgaaatgattcccccacttcctggagagactgagcggagttgggagcctttttagaaagaactttttataggacagggagacagcacagccatcccttgcaaaccaccaaggtgtgtggctgacctccagggaggagcactcactggagtgctcacaaggtgcacactgctgtgtgtaccttgcagacaggccggcgttcagcctccaaggggctcactcccccagttgccaaacactgtggatctctctgtcctcttctcccctctctcagattggcctggcagcccctggcacagagcagacccggccactggtagctccccacttccttactcctgctgctctgccattgccgctccccttcttgctgcccaagcactgccctcgggcgtctggcagcctgaggtgggtggaggggacagtgttctggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtgaaaaaaaatgg

SEQ ID NO: 14224 - DNA, 2113 bp, Homo sapiens
  misc_feature (110)..(110): n is a, c, g, or t
gtcactgagaagatggatgtgctgggcaccgtgggaagctgtggggcccccaacttccggcaggtgcagggtgggctcactgtgttcggcatgggacagcccagcctctnagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggtggacagagccatcactgcctgtgccgagttgcatgacctgaaagaagtggtcttggaaaaccagaagaagttagaaggtatccgaccggagagcccagcccagggaagcggcagccgacacagcgtctggcagagggcgctgtggagcctggagcgatacttctacctgatcctgtttaactactaccttcatgagcagtacccgctggcctttgccctcagtttcagccgctggctgtgtgcccaccctgagctgtaccgcctgcccgtgacgctgagctcagcaggccctgtggctccgagggacctcatcgccaggggctccctacgggaggacgatctggtctccccggacgcgctcagcactgtcagagagatggatgtggccaacttccggcgggtgccccgcatgcccatctacggcacggcccagcccagcgccaaggccctggggagcatcctggcctacctgacggacgccaagaggaggctgcggaaggttgtctgggtgagccttcgggaggaggccgtgttggagtgtgacgggcacacctacagcctgcggtggcctgggccccctgtggctcctgaccagctggagaccctggaggcccagctgaaggcccatctaagcgagcctcccccaggcaaggagggccccctgacctacaggttccagacctgccttaccatgcaggaggtcttcagccagcaccgcagggcctgtcctggcctcacctaccaccgcatccccatgccggacttctgtgccccccgagaggaggtgagggtgctgctcaggctgaggcctctggggagggacaggaggcctccctgtctcccctctggtctgggctctgggagaatgaaacgaccccagcttctctacggggcccgggaatggtctcacgaggttttccgatttggcccaagtggtttattcacattccttccaagctttgtgtgtgtgtacgtgtgtttattatgtgttatagggtatatgtgtgtgtattgttataggtgtgtgtgtattggagtgtgtattctgttacgtatgtgcatatgtgttataagatgtgtgtacatgtgtttattatgttgtagggtgtatgtgtgtgtattgtgttatgggtgtgtgttataggtgtgtgtgtgttatcggggtgtgtgtgtattctgttacaggtgcctgtaatcccagctactcgggaggctgaggcgggagaatttcttgaacctaagaggcagaggttgcagtgagccgagatctcaccactacactccagactgggtgacag

SEQ ID NO: 14225 - DNA, 2015 bp, Homo sapiens
  misc_feature (110)..(110): n is a, c, g, or t
gtcactgagaagatggatgtgctgggcaccgtgggaagctgtggggcccccaacttccggcaggtgcagggtgggctcactgtgttcggcatgggacagcccagcctctnagggttcaggcgggtcctccagaaactccagaaggacggacatagggagtgtgtcatcttctgtgtgcgggaggaacctgtgcttttcctgcgtgcagatgaggactttgtgtcctacacacctcgagacaagcagaaccttcatgagaacctccagggccttggacccggggtccgggtggagagcctggagctggccatccggaaagagatccacgactttgcccagctgagcgagaacacataccatgtgtaccataacaccgaggacctgtggggggagccccatgctgtggccatccatggtgaggacgacttgcatgtgacggaggaggtgtacaagcggcccctcttcctgcagcccacctacaggtaccaccgcctgcccctgcccgagcaagggagtcccctggaggcccagttggacgcctttgtcagtgttctccgggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagaggctgcccccacgcaggccaagcccctgcctatggagcagttccaggtgatccagagctttctccgcatggtgccccagggaaggaggatggtggaagaggtggatagatctattatgtgaaaggcagcttcacccagttttctggactctcatgcccccatctccgacctgggagacttcaggaatgacaacctacccagcctggtggggctggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgatttttttttttttttttgtacagagcttttaagcattaaaaacagctaaatgtgaaaaaaaatgg

SEQ ID NO: 14226 - DNA, 401 bp, Homo sapiens
gcccagtgtgtgcctggcctccctcgctgctatctgtgtggagcactcactgtctgcccagtactttctgtatgtgtagagtcctccttgagacagtcctgtgaggtagagtcttttccttgctatgaggaaactgacgctcagagaagttaacagaagtcaaggtgcaaacttgttcaggtcaccaagttcacaggccacagactcatcttcagaactcagtggccttagtggcaccctccctcccctgaaacactgctcctgcctctgctctcctcccaggtggcatcgaaggctggcatctacgagatccttaacgagctgggcttccccgagctggagagcggggaggaccagcccttctccaggctgcgctaccggtggcaggagcagagctgcag

SEQ ID NO: 14227 - DNA, 2427 bp, Homo sapiens
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactc

SEQ ID NO: 14228 - DNA, 733 bp, Homo sapiens
tcccggttaattgtaacgcagtcggtctttttaccaccagtttgaacttaagttcaagtgcttttttattacccccggtaccagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14229 - DNA, 3970 bp, Homo sapiens
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14230 - DNA, 4306 bp, Homo sapiens
accgtcagcgtgcgtgtgacgtcacctgcgcgcccgcctaaactcttcctagggttctttctagagtacgggtgagtgaaatttgtaaggtttggtgtgttcatttgagtgggtgccagacgtaacgggcccgggattgaattagtttagatcaaaatttgatgtaattatcgcagagaaacgctttcttacgagtgtttatctcgagcctgctgtgttcagcatctttcttggtgttttgggagaagcagacaggagttaagtccaagtccccgccctcacagagctcaggtggcttgggggaaggttggtgcgcaaacattaaaattagatatcgacactagtgagtgtccccgtcaagaggtctgtgaaataaggttgagcctacgatgcagaagttaatctcacagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14231 - DNA, 4205 bp, Homo sapiens
accgtcagcgtgcgtgtgacgtcacctgcgcgcccgcctaaactcttcctagggttctttctagagtacgggtgagtgaaatttgtaaggtttggtgtgttcatttgagtgggtgccagacgtaacgggcccgggattgaattagtttagatcaaaatttgatgtaattatcgcagagaaacgctttcttacgagtgtttatctcgagcctgctgtgttcagcatctttcttggtgttttgggagaagcagacaggagttaagtccaagtccccgccctcacagagctcaggtggcttgggggaagcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14232 - DNA, 3608 bp, Homo sapiens
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacattaaaaaaaaaaaaaaaaaaaaaaaaaaaaaaaaaaaaaaaaaaaaaaaaaaaaaaaaaaaaaaaaaaaaaaaaaaaaaaaaaaaaacgaagacacaaaaacaacaaaaaaaaacacaatagaacacaacacagaaccaacaaccaacaaaaaaaaaaacaaacacaagaaaggaggcgaggcaaaccagccacatccaaaacccacgcccgcgcggacagcacttaaccacaaaaaccaacgaacccagaacataacaataacacaacacgcagcctaccaacaacaaacgtgatgaacaccaatcacctaccaaccgacgcccaactcgcgcccacgatcaaaacaaaaacaataggaataagacataaacaacaaccagatagccagacgagtagtatcccaagaacgaaacacaaaccaatctagaggtgtgaaagaaactagagaaacgccaaaccaccacaagaaaccatacatccacgtacaatcacacaaacgggtacgtcgaagtaatac

SEQ ID NO: 14233 - DNA, 2833 bp, Homo sapiens
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgtta

SEQ ID NO: 14234 - DNA, 3916 bp, Homo sapiens
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14235 - DNA, 4085 bp, Homo sapiens
  misc_feature (572)..(572): n is a, c, g, or t
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggtatgctccttgatttacaatgaagttacatccagtgtacccatcataagtcaaaaattttataaatacaaaatgcattanattgcctaatagacccattctaaagtcagaagatgttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14236 - DNA, 3811 bp, Homo sapiens
gtccgctatcgtcgaccaggcgtcgtcttactagaggaccggccagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgtaatctaatattgccatccaatttagcatacataaaatgttgccactcaccttccctgtttgagcttcttttcctgacctgagttttgtatcagcaatgttgatgatgttagcatgggtatgggattagaaaatgtccttaccttaaatctcttggcttttactgggtgcaaggtaaataatggctatggattttgttttgctttctgttttgcttttgtacaaagagacctgcttaaacaagtactgctgagataagtgtctgatcaagctacagtgtactttaagtagaaatggcaaagttgctttgttggggtgctgatactgatgattttaggataaattcatttctttaaacttgtaatacatggttttattgcttgtttctctccaggatagtagagatttctctatttcacctcaacctaataaaagtggtcagatttataatgttaatgacttaatattatccttttctaatagtctcatgtaaaatatgccgctattacaacttacaactaattgaatgagatgttaacttagtaaaatagtttgatttttacctgacagtgtttgtcaaatttaaaatcatgaatattcaattttatacaaacatttatatatatatatatagatttgtgtatgttatttgccaaagacagatataaattacctggtttaatattagtgaagaataaataagtgcacacatttcaactgtttcatttatttgccctaagttgagctgaaaaatgatatgaggcaaagaatcgaaataggtgtggcaatgcagcagatgtttagggctgtctacatcccaggtactgtgctaagcactaaacatgtatttgatcctcacagcaacctatttttccgataagaaatctgaggcttgattgataagctgacttgactaagttcacacagtttgtaaaagctagagtctgtgccttaattcacataatctctattcagagcctgtactgttaaccactcaaggattctggaacagaagctaacagttttctgcaacgagtctttgacttaaacatctgaaataacattggaaatagattataagaggagtcagtgtgtttttctatagtttcaaaatacttttaacatcttattgtcaaaaagattggataactgactttctttgctcataataactctaaattctagttcctgagtacattaacacatcttctttacctaactaccaatgtcccccatcatcgacttatcagcttgtttgagacaatgagaaagactgattttattttcaagaatatagactcttggttcaaaacattttcaggaaaaatattttaaaaccctacagttgaacaggtgtgtttccgtgttgatgatgtgctcaggatacaaaggtgaaataaacattttttctgccttcaggaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14237 - DNA, 2551 bp, Homo sapiens
accgtcagcgtgcgtgtgacgtcacctgcgcgcccgcctaaactcttcctagggttctttctagagtacggcagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttatgtttatgtcaaatctttaagagatttttctacagaatcaatgtctttggttccagcaacaaattatatatatacacccctgaatcaacttaagggtggtacaattgtcaatgtctatggtgttgtgaagttctttaagcccccatatctaagcaaaggaactgattattgctcagttgtaactattgtggaccagacaaatgtaaaactaacttgcctgctctttagtggaaactatgaagcccttccaataatttataaaaatggagatattgttcgctttcacaggctgaagattcaagtatataaaaaggagactcagggtatcaccagctctggctttgcatctttgacgtttgagggaactttgggagcccctatcatacctcgcacttcaagcaagtattttaacttcactactgaggaccacaaaatggtagaagccttacgtgtttgggcatctactcatatgtcaccgtcttggacattactaaaattgtgtgatgttcagccaatgcagtattttgacctgacttgtcagctcttgggcaaagcagaagtggacggagcatcatttcttctaaaggtatgggatggcaccaggacaccatttccatcttggagagtcttaatacaagaccttgttcttgaaggtgatttaagtcacatccatcggctacaaaatctgacaatagacattttagtctacgataaccatgttcatgtggcaagatctctgaaggttggaagctttcttagaatctatagccttcataccaaacttcaatcaatgaattcagagaatcagacaatgttaagtttagagtttcatcttcatggaggtaccagttacggtcggggaatcagggtcttgccagaaagtaactctgatgtggatcaactgaaaaaggatttagaatctgcaaatttgacagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcaaaattgaggtcatataagcccagaagactatttcagtctgttaaacttcattgccctaaatgtcatttgctgcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggaggtacactcagtgaaatttgcaaactctcgaacaagtttaatagtgtaattcctgtgagatctggccacgaagacctggaacttttggacctttcagcaccatttcttatacaaggaacaatacatcactatggatgtaaacagtgttctagtttgagatccatacaaaatctaaattccctggttgataaaacatcgtggattccttcttctgtggcagaagcactgggtattgtacccctccaatatgtgtttgttatgacctttacacttgatgatggaacaggagtactagaagcctatctcatggattctgacaaattcttccagattccagcatcagaagttctgatggatgatgaccttcagaaaagtgtggatatgatcatggatatgttttgtcctccaggaataaaaattgatgcatatccgtggttggaatgcttcatcaagtcatacaatgtcacaaatggaacagataatcaaatttgctatcagatttttgacaccacagttgcagaagatgaagccctcaatctagaagagtagaggtccaaaggtgccatatgttcacactgtgagcctgcaagatctccacgttaacaaaggaaaactcttcctatgaatcttcatgatgataggccatgtctcttcttatttttgttttaaataaacatccaccttatcatgaattcttt

SEQ ID NO: 14238 - DNA, 725 bp, Homo sapiens
taatttaattcagttgatctatttttcaatcctgatgccagtaccgtgttgtcttaaattactgtaagtttatagtaagtcttgaagtcatgtacatggttctccaactttgttattttttaaaatgttatttaatattctagattttctgcacttccacataagtgatagcatctgctttgcaatctctacaataaagcctctgctatttgtttgtttgttgttgttttgaggcagagtctcattctgttgcccaggctggagtgcaatggcacaatctcagctcactgcagcctccacctcctgggttcaagtgattctcatgcctcagcctgctgagtagctgggattacaggcatctgcaccacacttggctaatttttgtatttgtagtagagatggggtttcaccattttggccaggctggtctctaactcctgatctcaagtgatctgcccacctcagtcctccgaagtgttgggattataggcgtgagccactgtgcccaccccagcctctgctattttcgaaggattatgctgaatttacagattaatttggagagaattgatatcttaacaatattgagccttctaaatcatgaatgtggcatatctcaccatttatttatattttcttcagtttctctcagcaacgctccattgttttcagttctacaatgaagttgtaatggacttaatttttttgccttttcctttttatag

SEQ ID NO: 14239 - DNA, 548 bp, Homo sapiens
tttcattgccaataattttaggcaagaagttccacatgagggcgatttggatataatttttcaggatggtgcaactaaaaccccagatgtcaagctacaaaatacatcattatatgattcaaaaatctggaccactaaaaatcaaaaaggacgaaaagtagcagttcattttgtgaaaaataatggtattctcccgctttcaaatgaatgtctacttttgatagaaggtaagatatttaagtcactgttttgttagaatactccttttgcatatttttcctaattaattattgtttaatacattttacagacaacctagtacatataaagtaaaaatagtatttaaatttaacaaaattgaatatatatgttaactaggttcaaatatatataagcacacgttcataaatttatcttaattacatttgaaattgtacttcagactcaagtgttaacatttaactatattgttggattgcattttattttgtcaatgctaagctgattgtctagttaagtaataataaaagaggctgattgcttatgta

SEQ ID NO: 14240 - DNA, 224 bp, Homo sapiens
aaaagaactcccgtcccctgggtcagcttacccatcttgcgtaagtccagtgattaaatcaataatgtttccatagttgaggattgagtacggtttttctgtattcccaataacagggatttttaaacatcatatttcagtcttactatgtagccttgaagaataatgatgtatttattgaaatggaaagatgtttgagctataaagcgaaaaatcagattact

SEQ ID NO: 14241 - DNA, 477 bp, Homo sapiens
gtaaaacatgaaagttatttttgcttttcaacagataataaaataaatgatttgaaatcacttttaagaaaaaatattgattaatggaagaaatggtctttcttggatataaagatgtcatcattattttattttttgtctttaatgtgcaagttctaactttcttctttatgtatttgaaaataaaacttgtgtaagactaagaaaatatttaaaatatgcgggctaagtcatgactttcaattaaattatgtctgtgtttattggggggtaaattctcagtccttctgattcaaggaacagtgatttctcccaatattaaattctttctcttagttccactcctcatcttggaaatgtgccttccagtgccttgtaatgtaaaatagatatttttaaaacttctgaactacctcattagttttttccttcttttttctctgttattttttactctgattaaagtaaaacaaacca

SEQ ID NO: 14242 - DNA, 930 bp, Homo sapiens
caacttactggacatatatacagaaataagggtatgtcctttaaatttagcataaagggaaaacaaaagctttagcacaatgccatttaattactttaaagcgtatgcatgcatacatacaaacatattcaaggctacgtgtcaaatacaagaagggtacccattaagaagagggtaatcggagtgggtttagggataaagaagaaaaatatacatgttattatatttaatacagcaagcctttgacatatatattcttatactcacatatgatattcttactactacataaataaatatagaagctgactcaaaattgtaagtaacttatataaggttgcattatatataagagcagagctagtattcaactcatatgtctgactctaaagccaatattatttccattatgcaattataaaatgaaaagaaaaatcagtattatcccatgtcattgacatgtaataaatggcacatatttatgtacatgcatatacccatgaaaccgtctctccaattaagacaatgtatatattcattaccccaaaatgttttcttgtgctactttgtaatccctccctcttcttcctccctgtccatcccaccctcgtccccagaaaattcctaatctgtttttctatagacatttacatttttacactatagactgtttacattttttagaattttatataaatggaatcttactgtctgtactcatttcttgtcttgcacttttgctcgacataataatattaaaactcattcatgttgattgtgtatctgtagtttatgcctttatttactgagtagaattatgttatatggatggaccacagttggcttatctgctcatttgttgatgaacattttactatctcctggttttggctattacaaataaaggtatcatgaacattaatgtgcaag

SEQ ID NO: 14243 - DNA, 399 bp, Homo sapiens
atatgaatgcaagaagagaataatcatgactttatgtgaatattgagcacatagttcattttttgttgtaagttacttttaggaaatcttagtgttagagttgttcaataataatatactttatcaaacttcataggttagaatgcaatgaaaatttaccccgaatattaacttgattgccctttattctacaaatggcacacctaagaacctccctgtctatgtggattctaactgtggcccagttgtccaagacagaattataaaacggtcatttagaatataacaaaaattaataaaaatggaacattatattgatgcaatattttgctaatctatgcaatcagaataacattttttctaaaaaatacttttaagtaaaataaaaaccaatttcct

SEQ ID NO: 14244 - DNA, 293 bp, Homo sapiens
ttatttttctgttgaaccttcctgtaaattgtgttgatttttaaaagctcaggtactaagttatactgtaagtctggaaaatgtgaatcactcttgggaaacagatgtggggcaatggcagtttcatattggcttttaaattgtactgaataggttgttacttattcctctgcactaattgtaaaatagactgatataatgaaccagtttgaatcactaaacttgagctttaacctgggattatggtgagtaggtcattctgcctacaaaaattaaaagaagggtacttttaa

SEQ ID NO: 14245 - DNA, 693 bp, Homo sapiens
cagagggctccaaaccctgactgaatccaacccgtggctccagggcctgcctccttcattaccaagtgaggatccacaaagacatcggctgtctattttcttttcttttttttgagacagagtctcactctgtcagccaggctggagtgcagtggcgcgataccggctcacagcaacctttacctcctgtgttcaagtgattctcctgcctcagcctcccgagtagctgggattacaggtgcatgccaccatgcctggctaatttttgtatttttagtagagtcggggtttcaccatgttagccaggctggtctcgatctcctgacctcaagtgatccacctgcctcagcctcccaaaatgctggaattacaggcttgagccaccgcgcctggccctcagctgcccattttcatccagctgtaccctgcagcccggtttcctcagacgcagtaacactgtgtcaccagaaaggcctccttcctgtacagtggctgcactgatgaaggcctgccatccagtctgtgataggagccagtcagaggcgggaaggagcaccttaacttttccttctcttcaaggaattaggatgatccctttctacaacccgctcattgacagcatttccagtgagaagcccaaggaaagcctttacttcagagaccagagcaggaagcccagagcacgagctttgg

SEQ ID NO: 14246 - DNA, 507 bp, Homo sapiens
ggtctccctttgttgttcaggctcatcttgaactcctggtgtcaagcgatcctcccacctcgacctcccagggtgctgggattataggcatgagcccccacacctggacacaaaatacattatatactctaaagtataggattactttaagagaaggaaactaaaagtatgatggcttactttctaatccataacttcacagttttcccttcctgcagctttcacagaaaaaaccaggtgcctggtactgggtccttctctctgccaagcaggagtaaggcggcagagccaaccctgcatctgcagttagaagctctccatgacgacaggacgcagcttctcacccaactgtttgcagccttctcctttccacctactgattgactcctgagctgaagcctggtgttatcctgtttgcatgtagtttgccatgagttagaacagtgagtaaagctctgctttttaaagctgtgcagaaagattcaaaaacttctggaaaggctttct

SEQ ID NO: 14247 - DNA, 558 bp, Homo sapiens
caaacccagctcgctaaccggcgcgggcagagtacagctcccaggctcccgaagcttcccacatctggaggatgacgaccctcccctgaccacatctggagggcgtccagctgcgagccagcggggcacagctctcttctcctggcctggatccccacccccccaacccaggaagactgagaatcccatcatcgcgtgcacatctcatcccaggagggagagaggagctgccgagtagaaagcagactggctgcagggacagaagacaccaagggcaccctcccccacagctgcgcctggacctcctgcgagaagaggaagccttaggggtctttattgtaccctcaagaccccagagagaaacagaagtgctgaggggtcgcaggcaggtctcttaccctctctgggcctcgaatatttatccataggaggctgaaggtaactgcctcgcaactcattcatgagggtcaatagggacgacagtggcaagaggggttggcacactgcccagactgttccaaagccagggctggggctgccaaaaaggccacctgtgct

SEQ ID NO: 14248 - DNA, 453 bp, Homo sapiens
gacagatctatgtggtgcaaaaaggtggacggtggcagatctagaaatgtgctgcttagaatttcttcaaaagaactcactacaggaagcccagttgactggcagtcctagatgccacccctctggattcaccactacattagctgcaaggccccagggctgctccctgccttggacagcacagtgatgatatgagtgcaagcacaacacaaactcctctggctggcaactttggcctaaggactccccatcagcctggcccaaccttctgtaggactgcaccaacagtctgagattcctcttacccaatcctccttccttccatctcttaccacaggtgttaggtttatggaagtctgaaggctcttcctgcctactcctactccctccgctttgtcctacacaagtgagttcctccaataaatttcttgcatgtctaataccatctagtca

SEQ ID NO: 14249 - DNA, 389 bp, Homo sapiens
gccttggttctaggctcttgtgtctcacctggactgtggccatctctcttagtttgtgtttcagccttccaatctcgtctcctcaaatctgtcttccttcatactgttgccaaatttatctgtccaaagcatatatctgaacatgccaccctcctaaacttacaagtcttcaatgaagaaaactgcaaactttgcgaagattataaaaagattgaaatgaaagccaggagttttatgtgctctctatatgggaaaacaatatagtaatgggtttggttttttttccaggtttatttttaggtttatcacaatgcttatcaaattcccaaagcgatttttctgagaaaattggaaaaagtaattcacttataaattaaacacatgagaat

SEQ ID NO: 14250 - DNA, 341 bp, Homo sapiens
cttttaaaaatcatttcctaccagccctcaccatacttcatttcctggaacagtaaaggagttcacttcactcgcaaatgcattatgaaaaatgtttaatgattttaaaccaaagtaccagatgatatgtacaataatgcctcatttatctaggataagaatcctataataacagctctccagaacagggcagagaacctgaaaataatatggagttctgaaagcagtggccatgaaacctgttttaaaacctaatatcttttttaccagagatttttgctcaatatgcaattcattaatcttacccctaatataagtaatcagaatatctggggatgagg

SEQ ID NO: 14251 - DNA, 918 bp, Homo sapiens
gggggatacaatatggctgattaataggtacaaaaatacatctagatagaatgaataagatctaatttactggatatttaaaaataactaaaagagtggaatttgaatatgcctaatacaaagaaatgattatatgtgcttgaggtgatggataccccatttatcctgacttgatcattaaacattatatgcttgtatcaaaacatcactggtaccccataaaaataaacaaaatagttgtatacattacccataaaaacagaaaaaataaaaattaaaaaattgaatcttatactgattctccacctttaccttagcagagcctaaaaaatgatctgttatctggttattttgtcgtttactactcctagcacttatcatctgtagtttcctaatctccagcatgtaggtcttcaaattcataatacttttttctttattgttttagagataggttcttgccattgcccaagccggagtgcagtagtgctatcatagttcacctcaaactcctgggctcaagtgatcttcctgcctgagcctcccgagtagctgagactacaggtgtgtaccaccacacctggcaaatgttgtaatcccagcacttcgggagcccaaggtgggctgatcgcttaagctcaggggttggagaccagcctgggcctacatggcaaaccccgtctctttaaaaaattaaaaaattagccaggtgtggtgatgcacacctgtggtcctacctactcaggagagtgaggtatgaggattgtctgagcccaggctcacaactgccaggatgttgcagtgagctgactgtaccactacacccatggcagagtgaggcccggtctcaaacaaaactaaaccaaaaacaacaacaaaaatttttttttcaaagtatgctactttattattaactat

SEQ ID NO: 14252 - DNA, 3873 bp, Homo sapiens
cgccgggccgtgctcttgctccggcacgaggggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgtaaaattttaggaaaattgaccaacaaatttgatgcccacaccattaagcgagaaatacttcctctggtaaaatcactctgtcaagatgtagaatatgaagttcgatcttgtatgtgtcggcaattagaaaatatagcccagggcattgggacagaacttacaaaaagtgtggtgctccctgaattaatagaactttctagggatgaaggcagcagtgtacgacttgcagcttttgaaactttggttaatctgcttgatatatttgatacagatgacagaagtcaaactatacttcccttagtgaaatcattttgtgaaaaatctttcaaagcagatgaatcaattcttatttctttatctttccatttaggaaaactatgtcatggactatatggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggccatgattgtttttgttgatcctaaaaacttccacatggaactctattctacattcttctgcctttgccatgaccctgaagtaccagtcagatacactattgctatttgcttttatgaagtatctaagcttctgaattctggagtatatttaatacataaagaactaataacattattacaagatgaatcactggaggtactagatgctcttatagatcatcttccagaaatcttggaacttatgtctactggtggagaaagcagtgttcaagaaaataagttatcttctctgcctgacttgattccagcactcacagctgctgaacagcgagctgcagcctctttaaaatggagaactcatgagaagctacttcagaaatatgcctgcctgccacatgtcatatcaagcgatcagatttattaccgtttcttacaaagaatgttcacaatcatgatgacaaataatgttttacctgtccaaaaggcggcttcacgaactctatgcatttttctgcgttataatcgtaaacaagaacagagacatgaggtcattcaaaaattaattgaacaattgggccaaggaaaaagttactggaatagacttcgatttttggatacctgtgaatttattatagagatattttcaaaatcatttttctgtaaatatttctttctacctgctattgaactgacacatgatccagtagcaaatgtgagaatgaaactttgctacctgttgcccaaagtgaaatctactctgaagattcctgctgataagcatctacttcagcagttagaaatgtgtgtgaggaaactcctgtgtcaagaaaaagataaagatgttctggctattgtaaaaagaactgtattagagttggacagaatggaaatgtctatggatgcttttcagaaaaagttttatgagaaagatttgttggatcaagagaaagaaagagaagaactacttcttttggaaatggaacaattagagaaagaaaagcaacagaatgatggaaggcccatgagtgataaaatgtttgaaaagaaacgtagagacactaagacaccaacgcaaagtctgcccaagaacatccccatttctgttcctggaccctcttctgtcaccccatcgacaagtaaagaaatcaagaaatccaaactgattcgaagccagtcttttaataatcaagcttttcatgcaaaatatggcaacttagagaaatgtgctagtaaaagttctacaacaggatatacaacttctgtctcagggttaggaaagacttctgtgctttcactagctgatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttaaaatccagaaaatccaatccttaaatcaactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagagacaagtctgcatttatttgtgcaggaaaccagccatttaattgttctagagttttagcatttaaaaatcgtatgaaagtctacatcagctgaattgtcctagcttgataagcacttggagggggacttggaaggtgagaaagatactgcattttctcatgagtctccaagcccacttgaaaagtcacactgaaaggatgcaaatagccgtctgcgattttggcggccctccggattgtggtgacaatatgttgtacccggacattcccaaatttaaatttggcagtgaaaattccacaaagatttctggtaactttgagctataaataccttaaaaataatagattgatgattttctttatttcctagagaatttattttataaatactttgtttacattttagattgtacttgtctttatttaaaatgatgaatctagtctgaatcagctgttattccaagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagat

SEQ ID NO: 14253 - DNA, 904 bp, Homo sapiens
cgccgggccgtgctcttgctccggcacgaggggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagtccatgaggatgcacacttatttatccagagagtatggatctcacatatgtttgtccagagggtgtgactctgtggaggagaacacttactgtggacagtcccagatgttgaagtcagcacaacaagagaaaaacccaaatcctgataagacttgaggatttttcgaaaattaaatgcaaaatagttggggcaaatgttgctgcgggagtcaagactaagtaatacagtaagaagatatgaagttggagagcttctcatgttcttcctttgtataaagtttgcatacgtacaaaacccaggactttaatgactttaagagggggcagaattgcatctcttggaagttaacagactcatgtgaactggaatgtacgttgtggccctcacaattgattttaatatttatttgcaaagtcctttctgtttctaaataaaagctgtgccttctg

SEQ ID NO: 14254 - DNA, 3966 bp, Homo sapiens
cgccgggccgtgctcttgctccggcacgaggggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagtccatgaggatgcacacttatttatccagagagtatggatctcacatatgtttgtccagagggtgtgactctgtggaggagaacacttactggaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgtaaaattttaggaaaattgaccaacaaatttgatgcccacaccattaagcgagaaatacttcctctggtaaaatcactctgtcaagatgtagaatatgaagttcgatcttgtatgtgtcggcaattagaaaatatagcccagggcattgggacagaacttacaaaaagtgtggtgctccctgaattaatagaactttctagggatgaaggcagcagtgtacgacttgcagcttttgaaactttggttaatctgcttgatatatttgatacagatgacagaagtcaaactatacttcccttagtgaaatcattttgtgaaaaatctttcaaagcagatgaatcaattcttatttctttatctttccatttaggaaaactatgtcatggactatatggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggccatgattgtttttgttgatcctaaaaacttccacatggaactctattctacattcttctgcctttgccatgaccctgaagtaccagtcagatacactattgctatttgcttttatgaagtatctaagcttctgaattctggagtatatttaatacataaagaactaataacattattacaagatgaatcactggaggtactagatgctcttatagatcatcttccagaaatcttggaacttatgtctactggtggagaaagcagtgttcaagaaaataagttatcttctctgcctgacttgattccagcactcacagctgctgaacagcgagctgcagcctctttaaaatggagaactcatgagaagctacttcagaaatatgcctgcctgccacatgtcatatcaagcgatcagatttattaccgtttcttacaaagaatgttcacaatcatgatgacaaataatgttttacctgtccaaaaggcggcttcacgaactctatgcatttttctgcgttataatcgtaaacaagaacagagacatgaggtcattcaaaaattaattgaacaattgggccaaggaaaaagttactggaatagacttcgatttttggatacctgtgaatttattatagagatattttcaaaatcatttttctgtaaatatttctttctacctgctattgaactgacacatgatccagtagcaaatgtgagaatgaaactttgctacctgttgcccaaagtgaaatctactctgaagattcctgctgataagcatctacttcagcagttagaaatgtgtgtgaggaaactcctgtgtcaagaaaaagataaagatgttctggctattgtaaaaagaactgtattagagttggacagaatggaaatgtctatggatgcttttcagaaaaagttttatgagaaagatttgttggatcaagagaaagaaagagaagaactacttcttttggaaatggaacaattagagaaagaaaagcaacagaatgatggaaggcccatgagtgataaaatgtttgaaaagaaacgtagagacactaagacaccaacgcaaagtctgcccaagaacatccccatttctgttcctggaccctcttctgtcaccccatcgacaagtaaagaaatcaagaaatccaaactgattcgaagccagtcttttaataatcaagcttttcatgcaaaatatggcaacttagagaaatgtgctagtaaaagttctacaacaggatatacaacttctgtctcagggttaggaaagacttctgtgctttcactagctgatgattcattccggactcgtaatgccagtagcgttccatcttccttttctcctaatactcccttaccgagtacttcccgtgggacaggtaactcagttgaccccaagagcagtggaagtaaagatacacaaccacggaaggctaccttaaaatccagaaaatccaatccttaaatcaactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatatatatttcttgagtaataatgtggttacggaattccaatgttatagtgaagtgtaatgaaaaacatctctaggaatgtgctttaaccactgctgcaaaagagacaagtctgcatttatttgtgcaggaaaccagccatttaattgttctagagttttagcatttaaaaatcgtatgaaagtctacatcagctgaattgtcctagcttgataagcacttggagggggacttggaaggtgagaaagatactgcattttctcatgagtctccaagcccacttgaaaagtcacactgaaaggatgcaaatagccgtctgcgattttggcggccctccggattgtggtgacaatatgttgtacccggacattcccaaatttaaatttggcagtgaaaattccacaaagatttctggtaactttgagctataaataccttaaaaataatagattgatgattttctttatttcctagagaatttattttataaatactttgtttacattttagattgtacttgtctttatttaaaatgatgaatctagtctgaatcagctgttattccaagctatcatgcttaagctatgtcaacagcatttatttgtactaatgctaatatttccatcaaaatttgcctgtggaatatatacagttcttaattttaaactgtcagttcttgagatataccgtgtgaagctattgtcagcttctctatttcaaaatgcaatcagcatataactatattgatattagaagatatttgttttttaaaatatattgatgtatgataaagatgatctaatttgtgaatgcatatgtatgtgtggttactttttataatgtgaaataatgaataatgaatttactcaaaataaaacataggttaatgagat

SEQ ID NO: 14255 - DNA, 1578 bp, Homo sapiens
cgccgggccgtgctcttgctccggcacgaggggcagcctcacgctcggctccagcggccaagagccggagaaagtcctgctggtgggcggccgcggggctgagggcgtccggcatcccggggccgctccggcccgggcggcgagagtgcccggcggtccatgcatccgccgccgcccgccgccgcgatggatttcagtcagaacagcctgttcggttacatggaggacctgcaggagctcaccatcatcgagaggccggtccgccggagcctcaagacaccggaagaaatagaaagattgacagtcgatgaagacctcagtgatattgaaagggctgtttatctgctcagtgctggtcaagatgtccaaggaacaagtgtgattgcaaatctcccatttttgatgcgacagaatcccactgagacgcttcggagagtgttgccaaaagtcagagaagccctgcatgttgcaggagtggaaatgcagttaacggctgcgatgtcatttctgaccattctgcaggacgaatcagtgtcaattcatgcatatacccactcattcctccaagtcattctcctgcatctggagcacagggacacaggtgtcagcaatgcatggctggaaactcttctgtctgttatagaagtattgccaaaagaaaccctacggcatgagattttgaatccacttgtttccaaggcacaactttcccaaacagtccagtctcgtttagttagttgtaaaattttaggaaaattgaccaacaaatttgatgcccacaccattaagcgagaaatacttcctctggtaaaatcactctgtcaagatgtagaatatgaagttcgatcttgtatgtgtcggcaattagaaaatatagcccagggcattgggacagaacttacaaaaagtgtggtgctccctgaattaatagaactttctagggatgaaggcagcagtgtacgacttgcagcttttgaaactttggttaatctgcttgatatatttgatacagatgacagaagtcaaactatacttcccttagtgaaatcattttgtgaaaaatctttcaaagcagatgaatcaattcttatttctttatctttccatttaggaaaactatgtcatggactatatggaattttcactccagatcagcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggtaataaatatgtatttatatttactgaggatttttattataactttaaaatatgtgcatagatggcattcaaaatattgccatttttgacacttgctgcttgcattatgtctagcatacatagtatgtgcagagtaaatatttgtgaaatttatatctctacgtataaatcagaataatagacacatatttggatctttcaaatatgatttttagttaaattacaattcagagaacatgatttcaatttaagtgaaacgattataatattag

SEQ ID NO: 14256 - DNA, 308 bp, Homo sapiens
gttattatccaaatctctagatgaagaaatggtggcttagaaaatgtatttgatgcattaaaaataatgaaaattaatgctgaggagaaatgaagatagaaataaaatggacttgactaccaggctaagaggttgttattttattgaaaaactagtaaggtaaccattaaatgtattcattcaaaaaaatgcataatcagaactgcacttgaagaatatgcatctgttagcttcatccaggagtatgaataaagagatgagagattcttagtaagattttaaaaatttatggttaaaactgctttgaa

SEQ ID NO: 14257 - DNA, 201 bp, Homo sapiens
gttccctaaatagccttatcagtaattgtcctgatttcagggtgaatttgtttagaattctttaaaaaaccctcagtatctggctgttgtgtttttcctgaaggattaacagtgaataatgataatcactagggttcatcaaactctaagacttatatttttctgagtggtatgaatctttttctcattaaggtataattt

SEQ ID NO: 14258 - DNA, 319 bp, Homo sapiens
ttacccagggaccttccccatctcccatgtccttttttcttatggcccagacctggaagtcctcctaagtgcttcctctccctcagcctaaccgctctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagctttt

SEQ ID NO: 14259 - DNA, 460 bp, Homo sapiens
ccattagctatcgtctcctccttgttttgttcccaaatgacagaataatgttaaagagtgagcagaaaggcagcagggcatagtgaatggaaggcatgcatcagctggaatcatgaatcttgcctggttcagcctcctgcaccaagctgcctaatctgagtctatctctttaaaaaatttctgataatgataatgactaccttatgtcagaaaattagataaaatgcacagacaaaatgctctctctcagtggaggggttataggtcattttgttgatgtttttgttttatttgaggtcattttaatttccttcttttgggttttcagtattttaaaaaattctttgattggcatgtattcattcatagattcagcattcagcaaatgtttatttactcctgttacaggctatagatgttaaacaggaaaaaataaaacacaatagaaaatattttgata

SEQ ID NO: 14260 - DNA, 421 bp, Homo sapiens
gctgggcggggccccggcggggagaagaggctctgtgcagccggggcggatcgcggggaagttcctctcagcgcctcaggtgtctgggcgtgtgcagctgtgttggcgcacacttgccgctacagcccttctgtcagccctttagcttcgatggggcgctggtggccgcctccccctaggttgtggatgagtcttggcctagggttcagggccctccggccgcgggaggatctcccgccaagcttgttgcttttccaagttagtgcctggcgtgtgtgtgggctgcataggggcacccctcgaggcccccttctcttctcccgcctggactgcgttcacgtttctaacatttctcagccccttctccccacatctggccttggcttacatagagtaagtttgctgtgagcacttgcctcga

SEQ ID NO: 14261 - DNA, 443 bp, Homo sapiens
aaaggcggacagagctgtgggccagcggctggcaaaaggccttggggcaaccagaactctccatcagggcattgcagcctttaagagaaggtgggaactgctgcatttgccccgccctggatctcagcccaggaaacccactgtcacagaacaacagtcttaggagctttcttatcgagacagtaggaagcttttaaacacatcagtggtgaacgccaggcgggtctctggaactttttcatcttggaaaactgaaactctctactcattgaacactgtacacttgattgagagcaaattgtatgtgtttttgccagcctcttcctgaaggcggacatttgtcttgatctgtattggaattctttatctatgtttaaattttgtatgagattgaattcatgtgtatgtgaactgaaatgaaattaaaatgtcaaactacaaaa

SEQ ID NO: 14262 - DNA, 535 bp, Homo sapiens
aactcagaggctcaccctgtggtgttttccctgctgggcctgatcttaggatagtaaaattgtttctcattgctcaaggaagcttctcgttttaccatcatatttactgttctgtggcacattttacaattaatcaacaaaattgttttggtgactttgtatctcttcataatttctgcttccttaaaacggagtgcatcttattttgtttctcagtttaaaaatgtctgtattttgcgtcaattttggcctgggctggcggcacactctctagacttcagcagcaccagcagctggaaacagcataggtgtgattcttcaaaagtgctgtcatcattgagtgaggagctgaggtccaggaagagcaggccaggctggagcaggtatcttgtagttttatcagtgcagccccaaggtagtgtcttggcctcagggaggccaccacggcctgcgttggacagccgaaacctggtttacgccctctcctgaatttgattgtgaagaaacatcagacaaaccccaatcgagagatatt

SEQ ID NO: 14263 - DNA, 401 bp, Homo sapiens
ggaggctggaagtcaaagatcaaggtgctggcagattctatgtcttgggagggcccacttcctcatttgcagacagccatcttttcaccgtgtccttccatggtggaaggcgtgatccagctctcttgggcctgttttataaggaaactaatcctgttcatgagatctttaccctcatgacctaattatctcccaaaggccccatctccaaacaccattacattagggattaaacctgaataatatgaattttgggaggacacaaacattcagaccacagcagctcttcttttattaagtcctccccttggtagtgtcattccctgtagggctacaaaggaataatccaatctggggacagtgtgaacatcaaaatcaattgaggacaacagtggattata

SEQ ID NO: 14264 - DNA, 1406 bp, Homo sapiens
agcgggggtaccgactctggggaccctcgccgaagagtcccaagggttccaaggccagagagaggtcctggtcttgattgctggcatgtttactcttccaagtacactgagatcaaatgcaaagacaaaccatcaaagaaaataactctaaaatctggacatgatatacaaagtgactgcctaaaggagctgaagagaggacataagtggatcgcctctgctgttgcatgttggcttggagaacagaagatgaggagccaaataagcaagtccttcagccccaggcttctagcacggggctgcatgtaggctatgcattctggggagtgaggagatcatgaatgctgaaaataaatgaaggaatccagaaaagcaagagtcaaagaaggcatctgcaggccaaatctctgatcaacccctgacccacatacacacaaaatacactcaaagcagctcagctaaagacaaagatctgcactcagagtagagctgcctccccagaaacagagctcgcagttcaggcccagcaagaaaattacctgcaaaacaaaggaaaaacaacactcatcagagaaaaagaacagaatctggaatcttcacaacctagcattcatcatatccaagattgaaacccaaattatgggacatatttaaaaaccaggaaaatggaacgtagtcttaagagaaaagtcaatcaaatctgacctggagatgaataatatattgaaacttaaaaggcaagggttttaatttttgttttcttgttttttttctgtttgtttgtttgtttttgtttttgttttttgagatggaatcttgctctgtcgcccaggctggagtgcagtggcgcaatcttggctcactgcagcctctgcctcctgggttcaaggaattctcctgtctcagccttccgagtagctgggactacaggcgcacgccaccacacccagctaatttttgtgtttttagtagagacagggtttcaccatattggtcaggctggtcttaaactcctgacctcaggtgatccacctgcctcggcctcccaaagtgctggcattacaggcatgagccaccgcacccagccttgttttctggggttttgttgagatgaggtctcactctgtcacacaggctggagtgtagtggtgcgatcccagctcactgcagctttaaactcctgggctcaagcaatccttttgcctcagctagcatgctcagttaatttttaaatattttttgtagacatggggtcttgctatgttgcctaggctggtcttaaactcctggcttcaagcaatccttccaccttggcctcccaaagtggtaggattataggtgtaagctctcctgcccagccggcaagggcttgaaagtgttatgttattttatagttttaggaggtt

SEQ ID NO: 14265 - DNA, 423 bp, Homo sapiens
agacccagaaagataataaataagtttatctgtcaggtttggcatgtggctgcagcagactcaaaaggtgattttgagtctgaaaaatgcatactactaatctacccccaacttcgtgtcctctacaagtgaggactgtagctccgtattggcacactttgcaaccctctatgtgttctgcagatggcagattttcctgggtctttcttgtcctttatgacagccaacatggacaaccaaacatgtgagtgaagacacctccagatgatttcagtcccagccaccaggtcaccattagcctttgagtcttgctagctgaggccccagacatcatagtgcagaagaaagctgtcttttctgtatcctctttgaattgttgacccatgggaagtgtaagcaaaataaagtgtttgttttctgcta

SEQ ID NO: 14266 - DNA, 399 bp, Homo sapiens
agtcttgtgagaatcaaataaggtgtttaagtaaagtgcctagtactttggcactcagtaaagaaatggtagctgctaccattattgtcattattattttaatactttttttaaagcctcccttttcagacacgcataacatttcagcctgaattgagaaattctatggcattttgcataatgctataaaatcctggttttactctttcaagcaagaatttctaatgtttatttttaaagtttgaatgagaaggtggtaggatataatagcatggccacctgaaaaaggtactggaaagtttgatcatcccttctcctcttgaagacccgcatttctgtctgtttacattttgaaaaggtctacaagggcccaactgtatacgccatgatgcttatgct

SEQ ID NO: 14267 - DNA, 286 bp, Homo sapiens
agacctactgatctagaagacggatctctctgagccataatttctgctcaaggcttgctaggggagatccttctaacttggctttatacacaagaagctagctcacaaaaatgtcggtattctagtagctatgcctttcattgaccagacctgagatttggcctctccatcacttcctctgcaggtgatgtagacatcatttctgctgacatctatgttgatgcagttctagagtcatctgtgtccctattatcctgaaaatgaaaattgatagcaaaggcagata

SEQ ID NO: 14268 - DNA, 244 bp, Homo sapiens
gtaaaacaaagaaacaaaaagaaaccagtccacagaaaccagagttgaggcatgtgactcagtgttgactctcaaggtgattaccctgtgaaactatgtactgttcttgcataacaatttttggaatcttttgctttgaaatgccttcagaatcagttcatgcagaatacacattatatacattataaataccaaaataccttattatatattttgcttaaacattgaattatctgttaaattt

SEQ ID NO: 14269 - DNA, 412 bp, Homo sapiens
gtgagaagtgatggaacagagtgccatgataagaaacggtataaaagtccttattttagttttggtggtcagggaaggtacgtttgaggatatgacattggagctgagactagaaaaatgagaaggagccaggggatagggaggaagaattctaagcacagctaattgtaagagcaatgtgaagtgaggagaaagtctgggcctgttccaaggatggatagaaagctaaaatagatgaagtttcctgaaaaaggaagattgaagcagaaaatgaggtaataaattattgccaacagtttatttcataaatttaactaaaatttcctggcatatttacagattacaagatgcccagtagattctgccagctttctattgcttaaaagtgaataaaaagacaaacacagcaatt

SEQ ID NO: 14270 - DNA, 549 bp, Homo sapiens
atcttacaggaagatatagtcactcttgaattatagtgtgagatacaaaactggtgtgaaaagtgaaatgaagagtctaaatgataaacttcctaaaaatctcaaaaatatcataaactattaataatggtttgttttataatttattttttgttttttttatggaatagtgtgttgtgtttcttaatagctacaacaagaatggccatccatccaatttcttttataatacaggttgagcatccctaattgagaaaaatcaaaattcaaaatgctccaaaactgaaagtttttgagcaccaacgtgactctcaaagggaatgctcatgagagcatttcagagttcagattttcagattaatgatactcaaccagtaagtataatgcacttattccaaaatctgaaaaaatttgaaatctgaaacacttctggtcttaagcgtttcaaataagggatactcaatctacagtattaaaaagaagaaaggaaaagtctcaattgctctactagtgcttaccattctttaaagaaaaatacctagttgtctt

SEQ ID NO: 14271 - DNA, 428 bp, Homo sapiens
ctttcaagaagaaattcaaaaatatgttggcctctgcctcaaatgagtgttggctgtgccatggtcccccctgtttttgaaaggaagctgaagtgagtggttagcttgggatatgtggtgtccttcctgttggcagttttccccttttcttttcccagtaagttggcaataaggaagcaaagaaagaggaaatgcctggtgttcctagttccattcttcttcaactaagttggttgcacaaaacaaatttaatttaaacaacatttttcacaatactaaacgacctacactttcaagtgttatcagagaacgttatgtttaggtttactctgagttgctatgattcatgaatataagaataaatacttcttgtgtttttataagaatatattttccattcattatcataatgttaacttttccatagt

SEQ ID NO: 14272 - DNA, 574 bp, Homo sapiens
gtttatgtatttactcagtattctgtagtaacaaacgtttgatacaccaagcaacatgaatgaatcttaattcacactgagcaaaagaaaccagacacacagcactgtaggatttcatgtatgtaaaaatagaagagagaaagctagtctatagtggctgaaagcagatcagtggttgccttgggctgggatggaggaggcagggcctgactgccaaggggcaccaaccaaccttctgtggtgaaggaactgttctgtttcttgattgtggaggtggttacacacgtgtagacattggtcaaaactcactggactgtgctttttaagtgtatgcattctattatatatcagttatgacttagttaatttttaaaagtagcagccttggaaattaattttaaaggtggagttccaatattaagtagctttcagaacaactctgctgatttttagatgatttatgtacatgagcaaagggttactttggaggcaggatggctcggctttgtgctagatgcctagacaatttagtctcaaatgtataatcttgtctgagttagctttgttttaccct

SEQ ID NO: 14273 - DNA, 687 bp, Homo sapiens
ggttgcttagactgcggcccacgtggaaggctcttagcaccctgcctggcccgaggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttccacctcaaataaaaattaagccatttcctatttaaa

SEQ ID NO: 14274 - DNA, 765 bp, Homo sapiens
  misc_feature (9)..(9): n is a, c, g, or t
gcggccgcncccacttcagataatgacaaagcaagggaaggagacaaacaaagagaaggaacaatttaagggacaagaagagaaaggggagaacaaggacagcaccttgacaaggaccccgctcgagccgctggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttccacctcaaataaaaattaagccatttcctatttaaa

SEQ ID NO: 14275 - DNA, 483 bp, Homo sapiens
gacaggtctgcactcatatttatacccacttttaactatatgcgaattaaggggcagtttatgcagaaatttctaggaaaagggtggcaactcttaagtcatcaggttgttgctgtggaaaggggcggtaacttctgggtgttgccatggcaatggtaaactgacatgacatattggtgggtatgtcttatagaaaatggcttccacccctgacctacctgttttagttagtcctcaatttggtcaggtgtctgagccctgcctcctacctctccaggacatgggcagtagcctggctgggcactttaaaaaggacagttgtatccaagcctttgatttttttctgtcaattttaacattttctgtctcagaaatatctatttcatctagattttcacatttttttcataaaattgttcatattttaatattttatctaggttgtctaaaacctgtttctcccttttaattctattctttctt

SEQ ID NO: 14276 - DNA, 797 bp, Homo sapiens
gaccaggtgtatgctgggagctagagagaagctgagttcacctcacagttctgcaggtagtcagaatatctgctgatagtgggggctagccatgttggcagtctgatcctctctactctgaacatgctgttctggagaattcatggcttccaaccctggtatatcttgccagcaaatgctatatgaatggttattccacaactaagctataggtcacccagaaacccccaggacagctgtcaggaggccaagactcagtataaggaggctacagggcagactactgggtttgacatgtaatgtggctcttatgctgacactggtaccccatgtttcttgccagaggctggagtaccattccctcatggaggttcttcacctagtgaccttcattgccatcttcatgggaatccccacacacccttactgcagttgggtttttatagcctccaggaccctgcctcccaccctgagctccagcattctgtcctgataatgtcatagccagttctggtcttcgtgttacttgagagggttgtagccagagaactagttgtgggtccccatcttgtacctttccttgagtaggtcaaagcctgctctcacacgagtctggggaagcccggcagcctggccttgcctctccaatgggaggggaaatgaggagggagtaggctgtctgaactgcttggtatgcctgacagtggactctctttctgctcactgaccctgagaaacagctttgtcctttatggctcctccttgactgtttcccgccctccaactgtcattatcct

SEQ ID NO: 14277 - DNA, 311 bp, Homo sapiens
gagactggagggtcgcatccggagctgggcccggggacgcccgctggtgggaagggtgcgcccgcgtcggaggccgcggctgaccctgctccggcgccgccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagacctactgcttcgacgccttccctaacatcgagaaggtgtccaagatcacgtcgccc

SEQ ID NO: 14278 - DNA, 253 bp, Homo sapiens
gcagaaagtgtgtggatagcgccacccaaaccagtcctactgttataaaagcaaatcaaagcactcactcctcctttttgctatgcctctgatttactttcattctttgtcctttttccccttttataccacacttttattcattcactacaattatattttttcattctcttctatgttctgtttttgaaaaaatttggtaacaatttctagagtgacctcatcaatttaaagtacaagctttccatattag

SEQ ID NO: 14279 - DNA, 297 bp, Homo sapiens
atcagatggaggcaagaaagcggcccttccactctgtccacaggaggtttatagccgtgttgtccaatagtcaccactagccacacatggctattgagaacttcaaatgtggctagtccaaactgagatgtgctgtgagtgtaaaatactcactggacttcataaacttagtatgaaaattaaaaatgtgctgggcgtggtggctcacgcctataatcctagcattttgggaggccaaggctgacagattgcctgagttcagaagttcaagaccagcctgagcaacatggtgaaatg

SEQ ID NO: 14280 - DNA, 531 bp, Homo sapiens
gaatgtgagaagtttgaatacaaatatccttcaaaacaggagttttaatctctacgctatattcccaaaacctaaatggagtgagaaaatgcatctttaatttttcttttatattagattaagtcagaaggcacgatttcactcttgactttgataattacagaaattgtagtttcaatattctttaaaaatacctaaaatcaggtttataactttcatttgccctagaaaatgaaggcaaacaaaccaccatgatattcatgctggaaatgagaaaaccaaggtcatagcaaggaagtaaaaccaaacagaatctctccccatcgaaaaataaccccgaaagctagaatgaaagatgacaaaattatgaccaaacacacaaaaaatacttcagtaatcataaatttgaaaagaaaaaatataaacgatgggaaagctagcttgggcccacatgcctaacacctcctctgccgcaccctcctttgcaattgagatgaccagcgacagcagaacctgggggttccaggtagg

SEQ ID NO: 14281 - DNA, 469 bp, Homo sapiens
cagtgtatcccagtactcaaatctgttgaccagagatgctacagcagtggtagttcttctccgcttggttgtctgatgatggtggtggtgatggtccacctttgaaatatgacttgactcattgctatctgtcctgccaccgccgatggaaacatcttctgcataggtgagaaactcccttcagtgaaagctatgggtaaattatttcagaaacttgctggcttgaagaaacaacatgaaaacagcagggaagttccttgcagtccactttgacatattgttaggaattacttctcattaggagcacctatgtggctctttattggtggtgttagtagtaaaagggagtaatgcactccacatgaatccttaaaaagagatttaaaaatcaacatggtattttttcagaataaaagtatttgcttttgctgattatgaaataatttgtggaaaaaaatagaaaagtata

SEQ ID NO: 14282 - DNA, 423 bp, Homo sapiens
tttttcttacaaaatatgttgagcattatatatttttgttgacaatttacaagacggaaaaattagggaagcaacaaaacttttcacaaaatatagtttgttggataacagcaaatttggatatttttaggaagagttggataatttccctcaattcgtgggatggctgttgtccacttttgcacatgttctgcctcctgtctgaggcattcacagctggctttggatttctgtgtctcctaaagcttctgtgaatctgaaaagtcatttctgaaactgtggtctgcggctgggagcagtggctcatgcctgtaatcctagcactttgggaggctgacacgggcagattgcttgagcccagaagttggagaccagcctggccagcatagtgagactatgtccctatttcataaaaacaaagaa

SEQ ID NO: 14283 - DNA, 352 bp, Homo sapiens
accaccatgcccggccgtcagtagtctcttttaaaaataacttaatcctctaagacacaagtgtagttttattgtaaaagattcaaacaatacaacaaaggaaaaacccctttgagcaccttctctcttttcccataatcccagtcctctcctcagaggtaaccactgatgtcagtttgctgtatggactaacagaaatagaccttgggcatatgttttgtgtttcgtttttattggtgttctgtgtaatggttttatgttggttatgtagcatcttgtaacttgcttttgtgcagttaatgattgtcctggcaatcttgccattatcaataaatcatttcttataattgct

SEQ ID NO: 14284 - DNA, 394 bp, Homo sapiens
cacaatttctgtcataactctcagctgactactttgcacaaatggagtagctgatcctaaagttcatgtggaaatgcaggagacttggattaacaaaaacagtcttgaactaggccgggtacagtgactcatgcctgtaatcccagcactttgggaggctgaggcaggaagatcacttggcctcaggagtttgaggccagcctgggtaacatagtgagacccctgtctctataaaaaatttaaaaattaggcaagcctcgtgacacccacctatagtcccagctactcaagaggctgaggtgggagggtagcttgagcccaggagtttgaggctgcagtaacctgtgattgtgccactgcactccagcctgggtgacagcaagactctgtctca

SEQ ID NO: 14285 - DNA, 925 bp, Homo sapiens
gtgccttttcccctgatgggaaagccttagcggttggcttgaacgatgggagtttcctggtggtaaatgctgacactgttgaagacatggtctctttccatcacagaaaagaaatgatctctgatattaagttttcaaaagatacgggaaaataccttgccgtggcatcccatgataactttgtggatatttacaacgtacttacaagcaaaagggttggcatctgtaaaggtgcttctagttatattacacacattgactgggactctagaggaaaattattgcaagtgaattcaggtgccagagaacaacttttttttgaagctccaagaggcaaacggcatataataagaccttcagagatcgagaagatagagtgggacacatggacctgtgtcctggggcccacctgtgagggaatctggccagcacatagcgatataactgacgtaaatgctgccagtcttaccaaagactgttcccttttagccaccggagatgattttggtttcgttaagcttttttcatatcctgtcaagggacagcacgcaagattcaagaagtatgtggggcacagtgcacatgtcactaacgtgaggtggctgcacaatgactctgtgctgctcacggtgggcggcgccgacacagccctgatgatctggaccagggagtttgtggggacccaggagagcaagctggtggacagcgaggagtcagacaccgacgtggaagaggatggaggctatgacagcgatgttgctagagaaaaggccattgactacaccaccaagatttatgctgtgagcatcagggaaatggaaggcaccaagccacaccagcagctgaaggaagtttccgtggaagaaagaccacccgttagccgagcagctccccagcctgagaaactgcagaagaacaatatcac

SEQ ID NO: 14286 - DNA, 418 bp, Homo sapiens
ctcccgcccctcatggtcaggcttctccttggttttgaaccaagcccctcttgtttcaagcccacatgttcttcctgctccccctgctcccaggagaaggttaagcagagggaggagggctgaccctgaccacggtgcctcaagcgtggggaggcccaacccagtgcctgtgaattcaggctgggtcccgtggcaggcggggagtgagagaggagggcaggactgaacagatccaagtggaggggcctttgaggcgggaggagagaggaggccggcactggcctagacaggccacaccgggaaggcagccttgcagcccttgttcaatgctgtgcttcctctggccgctctctcttccagaccacccgttagccgagcagctccccagcctgagaaactgcagaagaacaatatcacc

SEQ ID NO: 14287 - DNA, 444 bp, Homo sapiens
  misc_feature (407)..(407): n is a, c, g, or t
ctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtattcacctgatttttgatacagcagcagggaaggttttttcccagcctaccaggaaacaacaaaaccggggcgaggacatttcaagttcggaaaaccttaccaacttccaagtttttncacattttactttttgaggagttccgcaattttttca

SEQ ID NO: 14288 - DNA, 381 bp, Homo sapiens
agccttgaagtttatggtagaattggctggcagaggatcaggaagaactggggaatcatctgaattatttgctcccagcttttgtttcttctctacaggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtaggcccatgggattactatttgacttttt

SEQ ID NO: 14289 - DNA, 372 bp, Homo sapiens
tgcagcgagtcacagaataacaaatgtatctcatgtgtgaaccctgaagacaaatgtaagttctcatgccgctatattttattgctgtgtaattttctttccggtttgaaatcatgcttggccaacatgtaatcatttcaatgagaatttccagggaggaaagttgtctgctaatctttacttaagacttttttgttttccttttattagctaagcaacattataggagctgaaattcctgacagcagctgtggcaattcagcctaagaatggctgagaactgtaacccaaagtacatccaattactatgggattaacactggatgtatttttaattgactttcttaatgtagaatgtgtacatccccactg

SEQ ID NO: 14290 - DNA, 357 bp, Homo sapiens
ctgattccttgactcttcaattgttcctgagcagagataagactgaatatatgccacttaagtaatttttgtccagagggaattgtttggtaactgttaacattgctcacaaatacatggtaccgatctctgcaggaggagtacacattcccactctgtggcaggtggttgtgaccatatgactggcactcagcagtgaaatgtgagtggaaacaactgcccttggtttttagtccctctaccaccatgtcagcaacgatacagagaagtgactcatcagcccagatcccggagcaaagatcatgtgcatgcagtggggcacaggaaaccaggatggacttgttgctaaaactgtta

SEQ ID NO: 14291 - DNA, 205 bp, Homo sapiens
taagatgagttgtgcgcggtgatggccgcctgtagtcgcggctactcgggaggctgagacgaggagaagatcacttgaggccccacaggtcgaggcttcggtcggccgtgacccactgtatcctgggcagtcaccggtcaaggagatatgccccttccccgtttgcttttcttttcttcccttctcttttcttctttttgcttct

SEQ ID NO: 14292 - DNA, 401 bp, Homo sapiens
agcatttgaaacagaaagtgcaattgtactcatgcacttaattttccaaggttcaactataccaactttattatacaaggtttgtacatttcaaaactttaaaatatttttccagttcaatgaaagggctattttcaagaccaagaaatagcaaaattttgtgatgaccttttgaaacaagtagacctatcagttaaaaggtcaatgatatccttttacttgcatttccatttataaaattggcaattcttccttaaacaattgtcagtataattgacatagtacatacatttattctttatctactagtcatcctctgagtgctgaggtgtaaaggaggaggctgttatttgggatcttgagctgaattcatagcattgatcttaattcagccgagtgat

SEQ ID NO: 14293 - DNA, 371 bp, Homo sapiens
cttgctctgtcgcccaggctggagtgcagtagtgcgatctctgctcactgcaagttccgcctcccgggttcatgccattctcctgcctcagcctcctgagttagctggactacaggtgcccgccaccacgcccggctaattttttgtatttttagtagagatggggtttcaccgtgttagccaggatggtctcgatctcctgacctcgtgatctgcccctctcggcctcccaaagtgctgggattacaggtgtgagccaccgtgcctggccacccagctgatttttaacaaaggttccaaagcaattcagtggagtgcctttataacagtggtgatgggcaaatgactttgacctaaacctcagacttaca

SEQ ID NO: 14294 - DNA, 491 bp, Homo sapiens
gtctacatgtattttaataattaatcatttttattttctgagaatttcattatctcagtgtctcttactccctcctcaagccattgcagtctgtgtttttggtccatcactgccctgggacatcattcagtaaggtcaccagtggcctctctgctgcttatcctgcaggctatttacagtaacatctcagtattccagaatcatttgaatataatgaccagtttctccttctgaaaacttcttttcttggctttccatgttaaaaatctttctttctttttttcttttaaaataattaccctttttggtctctatccatactttctcttcttctttgcatgctatttcatttcagtctgagggtttctcatcctccaagtcttcactcactatttccctggtgatctgattcacatatagccacctacatggagctgacaattgaactcattaccttctttcccaatactactttttccatggttactaat

SEQ ID NO: 14295 - DNA, 2056 bp, Homo sapiens
atatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagtaggtttaagttagggtgggctgtgattttccatttaggtatctgaaatgcatttcagacttacaatgttttcaacctttgatttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatggaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttggctcactgcaactctgcttcccaggttcaagtgattctccctgcctccgcctcccaagtagctgggattacaggtacctgccaccatgcccggctaatttttatatttttaatagagacggggtttcaccatgttggccaggctggtctcgaactcctgacctcaggcgatccacctgcctcagtctcctcccaaaatgctgggattacaggtgtgagccaccgtgcctggccagtgtgtttttttcctttaaatatatatggcattatacatccagcaaagtttactgtgttatactcattgcatcatttgtttaaaaaaaaaaaagaaacttgtagcaggagacatttaaaaatatatttaggagttccttttaataactaagttagagactctctttcagtaagttctatgactgtaccttaatgaatgca

SEQ ID NO: 14296 - DNA, 443 bp, Homo sapiens
atatatactttagtttacaactatgattctagagacattttaagtactctttgccatctaaaaagcatccttttttcagtagcatcttcccaaacagagctgcccatagctttaaaggaaacacataatcataaattaatgtaataattaaaaacagctgggtgtggtggctcacacctgtaatcccagactttagggggcaaagacaggaggattacatgagcccaagagttcaagaccagcttgggcaacataggggaactctgcttctacaaaaaattaaaaaaaaaaaaaattagctgggtgtgctggatcacctgagctcccagctattcaggaggctgaggtgggaggatcacttgagcttgggaggccaagggtgcagtgagctttgattgtgccactgtactccagcctggctgacaaagtgagaccctgtctca

SEQ ID NO: 14297 - DNA, 447 bp, Homo sapiens
attatttgttgccatctgaagttccaaagagccaagattggatgtacatatttttaaaaatatgtgctttggtgaaaagcaaagttttggaagggtagaaaactttcagtagccaccaaattgtgttattttaaaatgagcagggaaacctcacagggatgagaatacctaaactgacaattctcaggaggccctgtcaaaatgcccatcctgctaaaggtttgagttcatggccaaaggcattgtttttttataaatataattttaatggctataataatttctgtattgctccattgtttggtatgtaactattgtaattaatgttgtcataaacatatttgtgtgtaaaactgtattttcttaaaacattggggcattaaacatgcctatatatatatatatgtatatatataaacatgcccatatatatgtatgacttaaaaa

SEQ ID NO: 14298 - DNA, 558 bp, Homo sapiens
agtgtgcctcaaaataatatagtaagcaacctgatattactggttttatataatcttagtgcactatcttattcataattaaagttacaacggtgactatgtggaagtatcttggaggagaaagtgaatagatgaggtggggggacatttgagtaataactttgattttggatgtcttctctactatttttagattataatttaaataagttcatgtgtattatattatttcaccaaaaattttactttaagatatggagaatgctccatttttccccgtaagagtagcaataatttttaaaattgtcttttaaaattagattaaattacttaattccagagacctgtgttgttcttgtgtgacaacacagagtatgcaactttaagttactggccgtctaattaaaaagatgtttccaaagtatgaccagcattggaatttgttcagacccatatttataaacagtaactatgacaactcattcctcccaaccatgctcaacccctcatactttcccaactgtctgttttacaagatgacataagtagagggtttgg

SEQ ID NO: 14299 - DNA, 517 bp, Homo sapiens
gtcgtggcttgaactctcaagtactgagattacctgaggtcaggagttcttgaccagcctgtccaacatagcgaaaccccatatctactaaaaatacaaaaattagccgggcatggtgtgggggtcctgtaatcccagcattttgggatgctgaggcaagaagattgcttgagtccaggagtttgagaccagcctgggcaaaaccttgtctgtgaaaaaaaaaaaaaaaaattaactgggcatagtggtgtgcatctgtagtcacagctacttgggaggctgaggtaagagaattgcctaagcccagggagtttgagcctgaggtgagccaagatcaagccactgcactctccagcctgggcgacagagctagactccgtctcaaaaaataaataaaccagaggtggggccacttgggtgacatcccagccctctgcaggttttgtgggcaccctggagtccttgccccctgtgagggtcttggcctcagctgggatttacaggtagggcagccctc

SEQ ID NO: 14300 - DNA, 1004 bp, Homo sapiens
tttgcagttttactttctgctatatgttttctttaaattgaaaatatgggtcaggcttggtggctcactcctgtaatcccagcactttgggaggctaaggcgggtggatcacctggggtcaggaattcaagaccagcctggccaacctggtgaaactccgtctctacaaaaatacaaaaattagccagtcataatgaccggtgcctgtaatcccagccactcgggagtctgaggcaggagaatggcttgaacctgggaggcggaggttgcagtgagccaagattgcgccattgcactccagcctgggcgacagagcaagactccgtctgaaaataaagaaaagagaaaagaaaacaacatgacatttctataacttaaaaacaacaaattatatttgtatgggttctcttatacatattgatgttctctgcccagtgagaacacagggtgtgtggtagattgatgtcaaaaatatggttggatcagtcttatcaggcagaattggaagtttctgtgtcagaccatgggaaataccataggccattgagcagggaagctatggtgagagtgctgatagaaatgatttggcaagccgggtgcggtggcttcactcctgtaatcccagcattttgggatgctgaggcaagaagattgcttgagtccaggagtttgagaccagcctgggcaaaaccttgtctgtgaaaaaaaaaaaaaaaaattaactgggcatagtggtgtgcatctgtagtcacagctacttgggaggctgaggtaagagaattgcctaagcccagggagtttgagcctgaggtgagccaagatcaagccactgcactctccagcctgggcgacagagctagactccgtctcaaaaaataaataaaccagaggtggggccacttgggtgacatcccagccctctgcaggttttgtgggcaccctggagtccttgccccctgtgagggtcttggcctcagctgggatttacaggtagggcagccctc

SEQ ID NO: 14301 - DNA, 621 bp, Homo sapiens
gttcttcagacctccttgtctataattgccaaccagagatttgtataagtgttaactgctttgcagccttactacttcagtagcatttcatgaacagaagatttaattaattctgagaagttgggcttacattctggaagaggtgactatgcatcagttaaatgaattgaatttgaggagagaacaactattctgctttcctcatttcagaagccactgtcacttattctgtgacctatcgtaagactcttggccctcatttgtctctttattgtgtgcctctgagtgtaaaagtctaacctctactgcaaactccctgatttaaaggctgtgacatttttttcttaactctctattatcccatcttctttataatgtgacaaccaaaagaaatttgagtaagaagcctgccaactttgagataggccgttactgcttcatcatgctctaacatgacaggataggtttcttgaatatattcagtcatactcaggattcccattcctgagccctacttaagtagaatagcaacttcatgttttgttctctcttgaaagtatcacacaataaaaacaatgtaattttttttatactaatatcccttaggtagccttttattgg

SEQ ID NO: 14302 - DNA, 562 bp, Homo sapiens
acagtaacaacaaacagccattcagagtaaatagtaggtacaaaataaaatactccttattgtatacctagtataatacagaagttaagaacttggtttttcatatgttagtgtgtttaatatgtactctttagtaaacaggtactggtagcccttggcttttatatcattgacttttcaaataactggcacatggaatactatacgtgtcacctctgaaatgccatttatatactggattttgacttacgaacatcatttgatgaatgccttttttgggctgtttgtgttgctgtcttgccaagtaacccccacctgctacagaactgtgactttgccacttttggcaaaaatttcaaaaattatttggaaaattttattgctttttaccttattttaacaaaacaagtggaaaaaggggaaatgaaagcatctagttatgagaaagtttattatcttgatataaaattgagacaataatcattagatgtgctgaaagtgatgaatctttattggaagtgctgcatggagttaagctgatgaattgtgaaaaaaattgtga

SEQ ID NO: 14303 - DNA, 408 bp, Homo sapiens
gatgacttcaaactcaatatgactttccttccaggtcacttcctctcctttccctgcttttgttgctagaccgccattcccctaggcacctatgctcaacattccagagacattttaagtgcttctcttctctcactgttcctatccaccgtcctctttagtctttctacccctggatctgacatccatggtttctatccttgccccagctccagccctacctagatcatggtcagggcatagcaattgcctctggggactctctatccagtctttcatcatgagccatcctgcatatgaccaccaaatcaatcttcctaaatatcgcttgtgttatacaaactcttttcagcatgtattaagtccctgtcactaaaatgatttcttggaaaataaaaattaagacgt

SEQ ID NO: 14304 - DNA, 143 bp, Homo sapiens
tcctcaaagatgtacaagcatgagaaggcaaaaggagttactagaggccacacctgcttctctggatctcaagaactggagaaaatttcatccctggtcccattccttaacccactttaccctacccccaacctgttccccac

SEQ ID NO: 14305 - DNA, 336 bp, Homo sapiens
tctctatttattttatttagttgtagtcatatcttcttgttcttgtcattttaattcttgaggatgtgatgtgtgcttctgggaataatttggattggataatttgaacaagttcacctaggcaaggtaggaagagtatttataaacatgttaaatatacagctgagtccttaatgaaataaggagagtaagagaatcctcaacccaaattagaagtactaaacaagtgtgacattgctgttatcctggggtggggaggagctgaaaatgagtgcccaacccaggattatgcaacacaggaagacataatccatgatgaatgacagttatccgata

SEQ ID NO: 14306 - DNA, 381 bp, Homo sapiens
gatcatgtgaaccagctccagccatgtgagccctgtggatcggggacagctgaaggctggactcggtgctcccggtccctttgtgcagcacccactgggcctgactgatctcctcccacattgctggcttcctccaggtcatgggcacaggtaacagagaggcactgagtagcctcttcatatccagattggagcagccaacacggccgttttacacctcatttgcctgcggaaccctaaatataaagctaaacctgtgctgaggtgagcggtatatgggatggtgtcacggtcccatcccacctcagccttagaggtgacctccatcccagctggcctggtatgtgagttcaggttagagttccttgccaagccaggcag

SEQ ID NO: 14307 - DNA, 475 bp, Homo sapiens
cagtgaatgctggttccctttcttcctttagttcccttgttctcaatgttaggactgataggtgtaagtctctgttgtggctcagaaagaggagagcttattctctggggatattcacagtggagggtgacagccatacctcttggtccctgagactctgagctcctgtttgcattttactttatagtgaaaagagcgagagtcgcacctggctagaccagggcagaactcactctgggccctctcaaggtcatcctccttgggttggcaccacccagctagggtctctcccgtgagaccccaggaaccttggcaggactgcaagggtggaaggggcatttggctctgaactggggagactcctttttcactctctttgtggcccctaaggtagtgatgctgaaccgtacggtatctgatcttgtgctctgtaaaactgaggaagaaagtgtgatgaaatcaggtagaaaaaaat

SEQ ID NO: 14308 - DNA, 217 bp, Homo sapiens
ttttttttctatttctttcctggtgtctgggtacattctcaatacacgaagccattgatatataaagtgtattagatatggtatctagtaatgacaaaatatgccaattgtgaacaaaaatcctggacccacttagtgttattgacactagcctggcctaatagcaatactttcattttttcagcccattttatagaagaattctgagacactactg

SEQ ID NO: 14309 - DNA, 1419 bp, Homo sapiens
cgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctactggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccatcctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagtt

SEQ ID NO: 14310 - DNA, 2188 bp, Homo sapiens
cgggaccagcagcagcgcagcggctacccagcgcctggcggactacagcccccctagccccgccctgagctttgcgcacaacggaaacaataacaataacggcaatgggtacacctacacagcggggggagaagcctcagtgccatcccccgacggctgccccgagctgcagcccacttttgacccggctcccgctcccccacctggggcaccacttatctgggcccagttcgagcggtccccgggaggcggacctgcagctccggtatcttcttcctgctcttcttctgcatcttcgtctgcttcttcctcctccgtggtcttccccgggggtggcgccagtgcgccctccaacgccaacctggggctactggtgcaccgccggctgcaccctggcaccagctgcccgcgcctgtctccacccttgcacatggccccgggggcgggagagcaccacctggctcgccgggtgcgcagcgacccgggtggaggaggcctggcctacgccgcttatgccaacgggctgggggcacagctgcctggcttgcagccgtcggacacgtcgggctcctcctcttcgtccagctcctcctccagctcttcatcctcttcctccgggcttcggcgtaaaggcagccgcgactgctccgtgtgcttcgagagcgaagtgattgccgcgctggtgccctgtggccacaacctcttctgcatggagtgcgccaatcgcatctgtgagaagagcgagcccgagtgcccggtctgccacaccgcggtcactcaggccatccgcatcttttcttaaaggcagcgggcgctgctagtgcgcaccgtgctgggggaagggggaacccctccccatcctctttccccagcgctcgcctgcctccctgggtgccccccctctcccttctccttcccggccccaccaacactctgagatccgagaggagcttggaaagctgtagtatccgctcatttttaaaatttaatttttaagtaaaggaatttgccaggatatctgcatcaagagtactgtagcctgggaaacctgaacacctgaaatgcatgctctataaataataggaacggcgacattctagtaatgatagtttttacactgtacttaataggaagcttccaaaagaagaaaaccccacaagttttccattttcttaaagtaggaaaaaatgaacagtaataattatgatgaagatgatagtagtgctatgggatgtgtggactgtttagtgtgttcccctttgtgggtgggttcctatgatacttattatagaacacagtggatcctttttgaatgttcgtggaagggccaggagttcctgtgaaaccaggatactgcagctttattaaagttaaagaaactgtaacatatctcttatatattaaaaacgtttaaaagttttaaagagaaattgcattaatacagattgaagtattttattcttttttgacttgaaaaattatatttcatattgcaaagatgtttacaagtattttaatttaagttcagtgaacttttttgtagctgggttaaatctttttattttagtatggccttatggcaaagaacactgtattattttaataatcacacaattgtgacggaattacaaccataaaatgtgtaatgttttgaacagtattctgttgggatggagattttataggttcagacaaatcttctagatctgcttcacccagcatattttctattcagtgatataaagcatattttattctatattattacaaaaacggaaatgtataaacatgtcaaaaagaactgttgatgctttctaacatttgtataaatagaattcagtgcaagttacaaaaattctgttgcaccactctagttttagtatttctattttaatacatttgtttaccacttgtttatgtatatgtaggtgatgttacttgagcttaaatgtactttactgagcaaagtttaaaaaacaaagtatattttattttatgataaagggcctttaacctcatggtcaaatactaatattatatttgctgagacaagatttgaaattgtatcaagagttttatttttctgacatttaaagttctacataataaaggtaaaacttaagtaatggtgctacttcattttttaagtatttctatataaataaaatattgaagaaaatcttaaaaa

SEQ ID NO: 14311 - DNA, 1872 bp, Homo sapiens
tgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcttttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttacagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaaaaaaaaaa

SEQ ID NO: 14312 - DNA, 672 bp, Homo sapiens
ccggggatatgacataaacccacatcggtggtcttactacagctgtgtatgggccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttacagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaaaaaaaaaa

SEQ ID NO: 14313 - DNA, 1939 bp, Homo sapiens
cacttgcggtcgggagttcgagaccagcctggccaacatagtgaaatcccgtctctaccaaaaaatacaaaaaaaaaaaaaaaatagccaggtgtggtggtgggttcctgtagtcccagctactcaggaggctgaggtgggagaattgtatgaacctgggaggcagaggttgcagtgaactgagatcacaccactgtactccagttgaggcgacagagtgagacccagtctcaaaaaaaaaaaaaagtgtgtgtgtgtgtatatatatgtatatatatatacacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacagaattaaaatattgtgaaaattacagcttaataaatgtttattgtaattttgttgtatggacttttaaaatatatctcatcacttctaaccaaaaaaatgt

SEQ ID NO: 14314 - DNA, 1842 bp, Homo sapiens
cacttgcggtcgggagttcgagaccagcctggccaacatagtgaaatcccgtctctaccaaaaaatacaaaaaaaaaaaaaaaatagccaggtgtggtggtgggttcctgtagtcccagctactcaggaggctgaggtgggagaattgtatgaacctgggaggcagaggttgcagtgaactgagatcacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacagaattaaaatattgtgaaaattacagcttaataaatgtttattgtaattttgttgtatggacttttaaaatatatctcatcacttctaaccaaaaaaatgt

SEQ ID NO: 14315 - DNA, 1690 bp, Homo sapiens
aaactaaagtgcacacacacacacacaccatgtacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaacagaattaaaatattgtgaaaattacagcttaataaatgtttattgtaattttgttgtatggacttttaaaatatatctcatcacttctaaccaaaaaaatgt

SEQ ID NO: 14316 - DNA, 492 bp, Homo sapiens
gtccagagctcccagcctgagagaggcctgctgggttgagcagggggcagcttgggactagttcttccacaggcctgccactatgactgcttgaggttagaccacagtctgacagggggaaaccctgtgcagtggctgggactgtgaggcagacaaggctcccgggaccccctttgtctaggacctaataatagcttaaaaactggcataggctgggcagcagtggctcacacctataatcctagcactttaggaggccaaggcaggaggttggcttgaggccaggagttcgagaccagcctgggcaacccaattctacaaaaaaaaaaaaaaaataataataattagccagacatggtggtgtgcgcctgtaagtcctagctactcaggaagctgaggcatgaggatcaggccaggaggctgaggctgcagtgagttatgatcactccatcccactctagcctgggtgacagagtaagtccctgtctcaaa

SEQ ID NO: 14317 - DNA, 368 bp, Homo sapiens
taccttacagggagcttaggcaaatttaaaactcatctttaaccaccatattgactgctcttttccatatatttatatttcctctttgtagccttgatgttttttattcttctcaatttaaaaaatgttattttttaactacctcatattccttatggaacaagacagaatattaatttttatactgccttctagtacaatatgataaaatcataattatagcaaatgtcatcattttttgtcatatgaatgtaatctatgattcagatgctgcttgttatagctttctcattgaggatctatggctcaggtctcgaggttttctttgtatccaagtcttaaactggaatcaattgaggacattcaag

SEQ ID NO: 14318 - DNA, 961 bp, Homo sapiens
aagagatgaggtctcactatattgcccaggctggtttcaaactcctgggttcaagtgatcttcccgcctctgcctcctgaagtgctaggattataggcgagagccactgtgcccagccattgtaatacagtcttttgtttgaaatgcaaatgttagtgggccaaaaggacagtgttattaatatccctattctatgaagatgtctgttctaaaactgttttagtgatgctctataacagaatcaactatatccattaatcccatggtgttgataaatgaactagtccagctcttcccagtggttaatagatgttaacagcactgtaaatccatttcggccctataatttctggagcaaacgtgtatttttgctgcttttcttataaggagatgctactaattgactatcagaagaacatgttttgaggtcctcctcaaaacattgatgggttggaatcagccatcaacagtgttgtaccagttcttgggtcttgatagacaatttggaaagagatttccttgtttacgaagtgaaggactaagaattaaattaatgaccttggcctcactggcaatcaattacaaatctctatatcagtaagagaattgtaaaattcagaagcagtttacattagactttggaatgaatgatgaactttccccattagagctgccatcatatgattggtggagattgtttaaagaatcattctatctcagcctcaaaaattaccacgggaagatggtatcagtatcactacttaacagatgaagaatctaatgctgtgtgcccatggacacacaaaattaagctgttgggacttgaacagctcaaattttcttgtttcagatcaccagctcttgagtaatagggaaatctggagatttgaaaagtacttgcactgtccacaacatggctaatccatatgtggatgatgcagaattgatttaattcactaac

SEQ ID NO: 14319 - DNA, 504 bp, Homo sapiens
gacaaaatccaacagccattcatgataaaaactctcataaaactaggaagagaaggagaacttcctcaacttgataaaaaatacctgcaaaatccctacagctaatgccatacttcatgctgagaaacttaagctttcccactgagatcaagaacaaggcacggatattccttctcaccactgcttttctcaatatcatatttgaagtcctggctaatgcaataaaagaagaaaatgaaataaaagatatatggattgatcaggaataaataaaagattgctcacagatgatatgattgtctgtgaaggaaatctgaaagaatcagcaaaaaataaaaataaaaataaaaaaaatcctggaactgagtgatgatagtaaggttgcatgatgcaagcttaatattcaaaagtcaattgctttcgtatatactagcaataaacagatggaatttaaaataaaaacacaatactatttacattcgcatgcaaggaaatgaaatactt

SEQ ID NO: 14320 - DNA, 303 bp, Homo sapiens
tgaagggacccctttatagattgagcatgatgtctgggttcaaagtctagttccttttcttgttggaatggtgactttgagcaagtaacttaacttctctggggctcactttcctcctctataaaatgggaataataatagtacttatcaagttattttgaagattaaataaaaagcactgataatactgtaaaacagtcaatacatttagctattatgtgttcatttattcatccactgatcaaattatattttaggtggatttttctgcatgctatggataataagagagagagggtggct

SEQ ID NO: 14321 - DNA, 444 bp, Homo sapiens
ttggctgtgtgtaatgagaccattgccccacccagggaaggatgtgtgcttctcagacgacagcagggcactttccctggtgtccctggtgcctctttgctggaatgctcccctgggtggaagccccgggctcacagggtgagaacccatatgctctgaatgtggaggtgaaagtgcgtcccattccaaagggtctgtaaggtgatgattcatccagccactccttcagcagacatttaatgagcatcatctgtatgccagacactgtgccaggtgctgggactacaaataagactagtttcttgacccactcagagattaggatttggaattaactgtgaaggacatgatggagatagaatgtgtttctgccagggcattgatttagaaaacctttttttgaatataactgtgcaccctgcatagaaattggagaaagaagaa

SEQ ID NO: 14322 - DNA, 779 bp, Homo sapiens
cagatgaaaagctgtcagaaaattatgccatcagaattcctgtaaacaagctcctgcttcacccctgccatgagcaaaagcttcatgcgtcctccccagaagccaagcagatgccggtaccatgttttctgttcagcctgcagaactgtgcatggaacagtggcacttttcttttgtcttgaagttgtagccattaaactgcactggccagtcaaatataggtcttgttaatgagacaagaaacacctgtgtttggcttgccatgaagaattatactggctgttttgacctctggaggaaggctgagccctttggcatcacatgtgtttgcagctcgtcaagctggctggatatcccacctctccatgccctatagctctgtctcggaacctgtgattgctgtgaattgtgtcatctgcacacagttcactaaccagttatgtatagactggttatgctacatttagtagtttgtgttttattctgacagttggaaagccacaagagagttttaagttggggagtaacaaataaatctataatttaatgggactaccatgcctgctttgtgacaaatggatcactagaaggcagaaattgtagtggggtgaccagtttgaaggatgttgaaatgactgcaaataaacaagtttcacaggttctttaaggaaaaaaaaaaaaagaaatagctgacaattctatgcccaatcaagttgtcattgagataaagttaacagaatgtttgttaatatataaaatgtttaaattaaatgttaaat

SEQ ID NO: 14323 - DNA, 456 bp, Homo sapiens
ttaagttgaaatacaagtcttcagctttggatatcttagttttgaagtctctgtgaggcatctagatagagttgtcaggcatttgaatatatgagcctggagctcaaagaaaagatttattatattttacaaagaagaaaagactgattagtatttacctggttaatctctccttgtcatgcatatctatgcttccatttcaattatgccaaggaagctttcttgtagtcccctgtctcaaccctaagactggcgtgattgactttcagtgctcgaataacagatgcaactaccctatcacagctctaactatcttgtaggccactttctgtttcttgtactacatcttgaacttcttacatggaagcactatttataggtcatgacctccccttttctgcacatagtaggtattgaataaatgtttgctgagtgaatggaaaaatgagcagatga

SEQ ID NO: 14324 - DNA, 362 bp, Homo sapiens
ttgatgaagctttccatttgccccagatactctcactctgcaaagcagggggccttggtttcccaccctaccaccttggtgggcgctctgaagacactgctgagaggctagggccacagaggagaaggtgctatctgggccttctgggactttgaggtgtggattccagcccaccttctgctcagtccacactgcccgtgatagctacatcaagggaccttcactggttcaggcccaaaatgaagtatcgtttctataacagataccttctagcgccatctttactcttctgagatgaaagtcatagcgaatataacctccttaagcacatactgaaaactaaatttaacaccctaacactc

SEQ ID NO: 14325 - DNA, 351 bp, Homo sapiens
gagagaaccacaagccaataaactgctggagatttctaggagctgatagcaggctctggacagcagccagcaataacttgggacctcagcccttcaactgtaaggagagttctgcaaacatcctgagtgcacttacagaaggatttacctccagttgagtttccagatgagaaccctgccctagtcagtcaacatgttgaagataccttttcagaggagcaagataagttgtgtccagactttttgacccacaaagactgtgagatagtaaatgttatttgatttaaaatgctaagattttggtaatgtgctacacagcaataaaaacccaataaaaattcttaaaaaaaa

SEQ ID NO: 14326 - DNA, 496 bp, Homo sapiens
cgggtgcctcaggaccctttgacatttcagtaccagaaatcaaatgtcgcttcagaagcccggccctccaaagatgtcacaatccaacctcccacacgcacaggagaacagcgcgtttggagggatgaagtaactcaccaaggtcacgcagtcctgcagagccaggatcccaacccaggaagtcctcagagccggccctcgccaccgactccctggaggtatgtccatttcactcaaatacccaacagattgagggtttaaatgtaatatgcccattttttgagacgtccgttctgttcagagtttgatatcttattttataaagtggaggtgatcgtggagccagtctcagggctgggtgttgtgggggcgtggatgaggtgaggcgggtgaacacggtatttgcgctcagtaattgctgggctgcctgtaactctaagcagagtcgaatgtcattctggaggggaaattaaagatgatctaagcagaaggcatt

SEQ ID NO: 14327 - DNA, 2680 bp, Homo sapiens
  misc_feature (1035)..(1036): n is a, c, g, or t
  misc_feature (1637)..(1637): n is a, c, g, or t
aaaaaagaatttatgcaaaggctgggtcagagtaatggacatgaattcgatttgccttgggtttgccttaccatttattgaaggcatactatgtactaggtacatacatgatcacatttgatgttcacaacagccctgacaagtgggcttcttacccctatttccaaaagagttcattgaagttctgagagcttaatccccgctttaggctacacagtagtagctggatttcctggcatcagaaccctcacctaggctgcctctgagcatggcttctgtgtcccagtctcaatttccatgaagtttcaggtcctcctgttcccccgcatttgtagtcactcttggtgactgggaacaaagggctagagcgtgagctgaaactgagacagggagtggcaggcaggcagtggggagagaaacttttctcacatccacccatgtgaagaagatggacaaaagggtggtctttctggagggaggcttccaagccactttcccaagactgctgatcttgggatgaatggcagggacctgattggggtaggggatgggtggtcacattgttttctgggctgtagactttatttcccttcctttgggaagagaagaggaagaggacagctcgggtgtgggtttgagccctggattaagactgcccgttgtccactaaaatctcttctttccttgctgcacgagggtagagagacacccagctggacactccatttcccagctgctcttgttgccaggtgtagacacaggggaatgtgaggcaagcatgtcctcaaagcctgatgacattgggtaaattctcctttgtgttctctctttcatgagctgggcagatgtgcctgagacaggtttgaccaggcaactgaaaagacatccctaagggaagacaaagcaaaggtatgaaaggaacacacgtccctgactgactaggaggaacagagctgcctgctgtctggaaccgcttcctcccagactaagtgagaaataaacttctgttttctataaactactgtgttttggggnntttgtgttatagcagttttgctgtcatcctttctaattcaccttctcacaccagatatttcaaattaaaaagattgtatcgggccaggtgcaatggcttgcgcctgtaatcccagcactgtgtggggctgaggcaggcagatcacttgaggccaggagttcgagaccagtctggccaacatggtgaaaccccatctctactaaaaaatacaaaaattagctggacacggtggcacactcctgtaatcccagctacttgggaggctgagacaggagaattgcttgaacccaggaggcggaggttgcagtgaactgacatcatgccactgtgcaccagtctgggctacaaaatgagattctgtctcaaaataaaaaaatgattacatcagatcacggaataactataataatatttattgggccagataagtatgcgaaggactctatgcacattatttagtgtaatctatgtgacaatcctctgagatatgtgttactattattccaatttacacacgaggaaacaggttcaaggaaggtaagttatgtgctgagggacacacaggagggggtggagctggatttcaagcccactgggtgtncagaactgagcctcttcaccatgggggcaaatccctcctgaggacggggctggaaaagccatggagatcatcttgtgctggacaagcctctcgccagtcaccacagggccctgagactcccattcctacctcaagaagctcagcagcctactactcatgttcatgttgggtcactgcatacggttttatttgaaggaaggaccccagagttaaaatcatttgaaaacccctgataaattcagtcccctccctctttttacaggtgaggcccggagacaagatatgacttgcttaaggtcacacacttagtttctctgtcaatctttctaaatcgaggacgagttctcttcccgctgtatcaggctgcctcaacaaacagggaagtacaaaaatagccaaatccaggaaggagggcagtggtctgtgtctcctccaattatttcatgggacagccaagcctatttccttgatttcccttgtgcccctcctgtcggatatctgctttgggacccatctcttttgggcttgcagagaggacgggctgcaccagttctctaccctcctcatcacccagatggtcaaacatgcaaagggaaaggagagctggggccagagctaaggcaggcaaagagactcctcgaccccctccagtctttccacatttatatttttggaatttcaggctccctcctccccctagacctttcctagtagcccaccagggagaagaagagggaaaactgccataaatttctcctatttatacaagatgacagagtttcttgtgccagaaaaaacacagaaagggagctgtcaagggagaagggacccagccctattccttctggggtcaatttatctttccgaatcatggcttgggggctaccctaacattgcctgtatgaaatgcaggctttgacttggggcagccaggccagacagcccctgagctttgcttctgatcacagttttcctgcttcatctcaactgccccccaccccttacgctgtctttttaaaaaacaactttcttgaggtataatt

SEQ ID NO: 14328 - DNA, 2076 bp, Homo sapiens
  misc_feature (431)..(432): n is a, c, g, or t
  misc_feature (1033)..(1033): n is a, c, g, or t
gccgcccgggatgagctaataatggaagcaatttgtaactttcagtagctctctaggcctgggtaccggagggagggaggcgggcagaggaggggagatgggcacccccagtctttccatcctcctcattcgtctaggggcacccgaatcccctattccttatttcccctatcactcaggcactggcagggtccttggcccactcctgttggccgccgcggctccaaagcgagctgggcagatgtgcctgagacaggtttgaccaggcaactgaaaagacatccctaagggaagacaaagcaaaggtatgaaaggaacacacgtccctgactgactaggaggaacagagctgcctgctgtctggaaccgcttcctcccagactaagtgagaaataaacttctgttttctataaactactgtgttttggggnntttgtgttatagcagttttgctgtcatcctttctaattcaccttctcacaccagatatttcaaattaaaaagattgtatcgggccaggtgcaatggcttgcgcctgtaatcccagcactgtgtggggctgaggcaggcagatcacttgaggccaggagttcgagaccagtctggccaacatggtgaaaccccatctctactaaaaaatacaaaaattagctggacacggtggcacactcctgtaatcccagctacttgggaggctgagacaggagaattgcttgaacccaggaggcggaggttgcagtgaactgacatcatgccactgtgcaccagtctgggctacaaaatgagattctgtctcaaaataaaaaaatgattacatcagatcacggaataactataataatatttattgggccagataagtatgcgaaggactctatgcacattatttagtgtaatctatgtgacaatcctctgagatatgtgttactattattccaatttacacacgaggaaacaggttcaaggaaggtaagttatgtgctgagggacacacaggagggggtggagctggatttcaagcccactgggtgtncagaactgagcctcttcaccatgggggcaaatccctcctgaggacggggctggaaaagccatggagatcatcttgtgctggacaagcctctcgccagtcaccacagggccctgagactcccattcctacctcaagaagctcagcagcctactactcatgttcatgttgggtcactgcatacggttttatttgaaggaaggaccccagagttaaaatcatttgaaaacccctgataaattcagtcccctccctctttttacaggtgaggcccggagacaagatatgacttgcttaaggtcacacacttagtttctctgtcaatctttctaaatcgaggacgagttctcttcccgctgtatcaggctgcctcaacaaacagggaagtacaaaaatagccaaatccaggaaggagggcagtggtctgtgtctcctccaattatttcatgggacagccaagcctatttccttgatttcccttgtgcccctcctgtcggatatctgctttgggacccatctcttttgggcttgcagagaggacgggctgcaccagttctctaccctcctcatcacccagatggtcaaacatgcaaagggaaaggagagctggggccagagctaaggcaggcaaagagactcctcgaccccctccagtctttccacatttatatttttggaatttcaggctccctcctccccctagacctttcctagtagcccaccagggagaagaagagggaaaactgccataaatttctcctatttatacaagatgacagagtttcttgtgccagaaaaaacacagaaagggagctgtcaagggagaagggacccagccctattccttctggggtcaatttatctttccgaatcatggcttgggggctaccctaacattgcctgtatgaaatgcaggctttgacttggggcagccaggccagacagcccctgagctttgcttctgatcacagttttcctgcttcatctcaactgccccccaccccttacgctgtctttttaaaaaacaactttcttgaggtataatt

SEQ ID NO: 14329 - DNA, 1586 bp, Homo sapiens
agccgctgagaggctctgcgtgtgcgtgtgcgcgggtgacgccgtgtgtgtgcgagtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagagtaagtatcacattcacaggatgaattaagaattgccaaggtgttcaatggataatggaaactgcagcatctcctgtcccccagccatgtcattctagctgtgaactggcacgaatgtcagcagcttttcattcagctgaatgctctttgagagattagggcagagaatggagtgttttaatgagttggaaattcatgctttgatgagatataagacctatgtgcatcttttctaatacctcctgcacccttctcctgaactctgcaaaaaaaaaaaaattgttatttttgaatgtcactatttgattatcatcatcattattattacacaaagtcaagggaaatatggcaaagtattgttatcttgttttgataggaaattacagaatagctttttggaagatttaaatttggaaaataatatgttcatcctttgaaaagtagtactcatatgttatttttaaatgaatcttttctctctccttttacctggaccgcagggttagatttcagccctcgtttattgaaaatagctgcttttctatcagtcaaccttgtacctagaattgaacctaaatgattga

SEQ ID NO: 14330 - DNA, 1410 bp, Homo sapiens
agccgctgagaggctctgcgtgtgcgtgtgcgcgggtgacgccgtgtgtgtgcgagtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccaggaaaacggcgtatccacagatgtgattttgaggggatgcaacaaagtgttacacaaaaagttcttcacctggaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtga

SEQ ID NO: 14331 - DNA, 1356 bp, Homo sapiens
agccgctgagaggctctgcgtgtgcgtgtgcgcgggtgacgccgtgtgtgtgcgagtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccaggaaaacggcgtatccacagatgtgattttgaggggatgcaacaaagtgttacacaaaaagttcttcacctggaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtga

SEQ ID NO: 14332 - DNA, 1214 bp, Homo sapiens
tatggagtctccctctgttgcccaagctggagagcagtggcatgatcttggctcactgcagcctccacctcctgggttcaagcgattcttctgcctcaccttcctgagtagctcggattacagtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccaggaaaacggcgtatccacagatgtgattttgaggggatgcaacaaagtgttacacaaaaagttcttcacctggaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtga

SEQ ID NO: 14333 - DNA, 351 bp, Homo sapiens
taatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacaccc

SEQ ID NO: 14334 - DNA, 394 bp, Homo sapiens
gtcagatttctacttaggcatcttatgttttcctttttttccattagtttttttcttaatcaaatttacatggtgagttcacggcagacacatctggctactgtgatttttccagctctgatgttctcactgcttttggaactttgtggtttatgcagcatagattagcctaaagtgcaccggcacatacacgcacaaacccagagacaaacaaacaaaaaaatacccatacactttttgggagatggtggaagtgaagtgttgggtgttgtgggtgttgtaggtgttgtaggattgttgtggtggaaagtttgtgtttatggaagaaaaggaacactggtgggcacaggacagggggaaaggtttctatttaaaaatgattttcttgattaaa

SEQ ID NO: 14335 - DNA, 720 bp, Homo sapiens
ggaagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagatgcttcgtcttgggtaaactcctcgactcccaaggccccagcctccatctttacctcagagcctcctgaacctcctcctccagcctcaccttcctccagcctcaccactcctccctggacctgcagctccgcacccccgggggcctcagaactaccccttccagggcctcagaactacccctacggtttctcctgcgtaaccttctgcctaccttcctgagagtggttggtgacagcagccggggctagaaacctcgaggcgactgtgcttgagtcctctcttgctctttacatcccaaatcccatcaattgtcacgccttgtgccttccgcctctcaaatattcagaaagcagatgtatgctgggcacggtggtgactcaagcctataatcccagcacttcggaaggcggaggcaggaggatcgcttgaggccaggaattttagaccagccggggcaacatagtgaaaccccatctctacaaaa

SEQ ID NO: 14336 - DNA, 585 bp, Homo sapiens
tgacggcctcgccatgtgtcccatcatgccccacgcgctcccactgtgcgccccacctcgcacccgtgccccatcatgctctgcgtgctcgttaggtgccccatcatttcccgctcgctctcattacgtacccagcctccggcccctgtaagtgccccatcgtgctctctgtcgctccagttagatgccccatcctgccccgcgagctccaattacgtgccccacctaaccccccatgtccgtgccccatcatgccccgcacgctctggttacatgccccgcctggcgctcccgcacatgccccatcatgctcagcgcgctcccattacgtgccgccacctcgcgcccctgcaagtgcccaatgtgccctgtgtggtcccgttacgtgtcccatcatgttttgtgcgctccgattacgggccacacctggcaactcaccgtgcgacctctgtagttccagagctcgcgagggccagggccgttggcggcggttggaacgaaacgatgagtgcctcctcgtggccccagaatggaatgccgccgtcggtaggggtctgccgggcataaaggggccttcggaacccc

SEQ ID NO: 14337 - DNA, 1626 bp, Homo sapiens
tgacggcctcgccatgtgtcccatcatgccccacgcgctcccactgtgcgccccacctcgcacccgtgccccatcatgctctgcgtgctcgttaggtgccccatcatttcccgctcgctctcattacgtacccagcctccggcccctgtaagtgccccatcgtgctctctgtcgctccagttagatgccccatcctgccccgcgagctccaattacgtgccccacctaaccccccatgtccgtgccccatcatgccccgcacgctctggttacatgccccgcctggcgctcccgcacatgccccatcatgctcagcgcgctcccattacgtgccgccacctcgcgcccctgcaagtgcccaatgtgccctgtgtggtcccgttacgtgtcccatcatgttttgtgcgctccgattacgggccacacctggcaactcaccgtgcgacctctgtagttccagagctcgcgagggccagggccgttggcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagatattacattgtggggcatggagctgggccttctgagcatgcagagaggagagctggccaggtttctgttcaaaccgaactacgcctatggaacgctgggctcccctcccttgatccccccaaacaccactgtcctgttcaagattgagctgcttgacttcctagactgtgctgagtcagacaagttttgtgctctctcagctgtacgttgcagagcacaaatgtcagcactttatagagagacaaatgggttggtgtttttggtaattcttctagatggcctgccctgaggctgatcgtccgccactgcactccagcatgggcaacagagcaagactccatctcaaaaaaaaaaaaaaagccagctgggattttttttttgagacatgaccttgcactgttgcgcaggccggagagcagtgatgtgatcatagcccactgcagcctcaaactcctgggctcaagcgatcctccttcctcagcctcctgggtagctgggactacaggctggcaccacaacgcctggctaatttctatattttttgtagagatcatgttgccaggctggtctcaaatttctcggctcaagcaatcctcccaccttggctcttgaagtgccaggattacagaagtgagccgccacacccagccacagctgggattttgatagggattgtgttgaatctgtagatcacttctgaagtaatgaaattttaataatattaagtcttttaatccatgaacatgatttccttccatttatttaggtcttctttagtttctttcaatgatgtttatagtttctttttcttttggagatggagtcttgctctgtcacccaggctggagtgcagtggcatgatctcggctcactgtaacctctgcctctcggttcaaggctgcagtgggctatagtcgtgccacttcactccagtctgggcaacagagcaagatcctgttta

SEQ ID NO: 14338 - DNA, 709 bp, Homo sapiens
ggaagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagatattacattgtggggcatggagctgggccttctgagcatgcagagaggagagctggccagagatcatgttgccaggctggtctcaaatttctcggctcaagcaatcctcccaccttggctcttgaagtgccaggattacagaagtgagccgccacacccagccacagctgggattttgatagggattgtgttgaatctgtagatcacttctgaagtaatgaaattttaataatattaagtcttttaatccatgaacatgatttccttccatttatttaggtcttctttagtttctttcaatgatgtttatagtttctttttcttttggagatggagtcttgctctgtcacccaggctggagtgcagtggcatgatctcggctcactgtaacctctgcctctcggttcaaggctgcagtgggctatagtcgtgccacttcactccagtctgggcaacagagcaagatcctgttta

SEQ ID NO: 14339 - DNA, 306 bp, Homo sapiens
ggggcatttgaactgagcccagaagtttgaataaaatttctatcactagaagctgggcacaggctcaggaggaagacattgcaggaagagggaactgtgtgagggagacatggaggccagagtactgctgacttagagggggaagaaactgatagcattaagcaggatactgagcaagcttcacccaccttctttgtcccttcttacagatattacattgtggggcatggagctgggccttctgagcatgcagagaggagagctggccaggtttctgttcaaaccgaactacgcctatggaacgct

SEQ ID NO: 14340 - DNA, 411 bp, Homo sapiens
tacataaatttagaattttcatacatacacgtaaaggtgtttggttttttaaaacagaaaaacgtaagcgcgttatctcccagtaatgtctttgcaggtaaattaaaataattacatatatatttatatttatatatatatattttttctaagagatggggttgttgcccaggctggtcttgaactcccgggctcaagtgatactcccacctcaggctcccaaagtgctgggactgtgggcatgaaccaccgggtccagcctacagaatcatttttaatggctgtatggatatcataatttgttcaaccagtccctaagttgttggacttttcaggtattgacagcttttcaggtctacaatcctagatgaatattcttatatgtaaatctgtacatgtccctgattattt

SEQ ID NO: 14341 - DNA, 1245 bp, Homo sapiens
gccatgcttacccttcagttgggcacctgtgtcctccttcccattggccttctggtcctacccaagtgtccagtccacgggtctcagtaacacctctttgcccagccctgtggtagcgttggctgcctcctttacctactcaagtaaccgctttaccactaatttattgttttgtgttttcatctataggatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccgggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcaacccacctattctaaccacttcttataaataaaatatcttgggggggggccggacccaattcgcctataggggggggttacaattactggcggggtttaaacggggtgattggaaaaacctggggtaccaaattaatgcttttggatccctttttcagtggggtatcgccccccc

SEQ ID NO: 14342 - DNA, 1531 bp, Homo sapiens
ggctatgatatgtgggagcagagaatggggtgggtgggtggagcacatgccagatgaggatctatcagcaatgggagggggcatcccgccctgctcctttagcatctccaccctgctcctctcagaggaccgcctttgattgcattcagctgcgatggtagcaagaacacgggcacactgaggatgaggagagtgggagccttgtgctctctctgcatatgaggcaggacagcacagggtatggagcagtctgcagagaggccagttcatcagctcatcagggaagcacttgtcttccaccttgggctttgactgagcactgggcaattggcccctggggatcaacggaataatcctaagcagagttactctatgtcacactatggaatgttccaagtaggtggccatgtcttttcctcctttcgttgttgccatttcataggtttaggtttgggtgtatgtttctcctctctgaatggcactcgaatgtttgctgactcttactctgtgtgactggggcatatagctatggactgagtatgaaagatgatcaaagatatttcatgatcaaagcagtctcttcttttctgacagctgaagaagcatctgtagggaatccagaaggagcgttcatgaagatgttacaagcccgggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcaacccacctattctaaccacttcttataaataaaatatcttgggggggggccggacccaattcgcctataggggggggttacaattactggcggggtttaaacggggtgattggaaaaacctggggtaccaaattaatgcttttggatccctttttcagtggggtatcgccccccc

SEQ ID NO: 14343 - DNA, 1035 bp, Homo sapiens
ctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgtaagttattttttcttagatttatttttacttagttggttttttaggtttgttttattattttcttaagtcaggtttattgagatttaattttcatataacattcaccctttataagtgtatagtttgatgagttttgacaaatgtatagttacataaccaccac

SEQ ID NO: 14344 - DNA, 742 bp, Homo sapiens
agtgacagagggtgatcctgtctctaagtaagtaaataaataaagtatatgggggggggtgtgttggttatatgcagacactgcaccattatacgtaaggtattgagcatccacagattctggtatggtgtgggggcgatatcctagaaccagtcctctgcaaggtagcaaggatgactgaactgtggaagaatcaaagcactgttaaacagcatacaattcctgtcttcaaaaaagttatctcatcgggtagatgagacttaaaatgaataaaaggaatgaatacacattggagatagtggttgttgtgatagataaccttaattgtgttttcttccaaaacaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcaacccacctattctaaccacttcttataaataaaatatcttgggggggggccggacccaattcgcctataggggggggttacaattactggcggggtttaaacggggtgattggaaaaacctggggtaccaaattaatgcttttggatccctttttcagtggggtatcgccccccc

SEQ ID NO: 14345 - DNA, 620 bp, Homo sapiens
aatatctagacatgggaacaacacacatcacacttacaacacttaagaacattctcacgatgactgttgaactggaagaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgtaagttattttttcttagatttatttttacttagttggttttttaggtttgttttattattttcttaagtcaggtttattgagatttaattttcatataacattcaccctttataagtgtatagtttgatgagttttgacaaatgtatagttacataaccaccac

SEQ ID NO: 14346 - DNA, 468 bp, Homo sapiens
tgttgagtcaggtcccaccgagagccggcaaagagtctgactgtggggaccctgcccttttccagaaggtggaggtgcagaggagctcgtaaggatcacggcttctcaacctggccctgaacccactcacatcagcagctctctgcaaggccaactggacagacagctgtcaccaataaattaaaccttatttcttgccaggtgcagtggctcatgcctgtaatcccagcactttgggaggccaaagtgagaagatcacttgaggccagaagttcaagaacagcctaggcaatatagtaagaccctgcctttacagaaaattaggtgggagtggtggcatgtgcctgtggtcccagttactcaagaggctgaggcaggatgatttgttgagcttaggaggttgaggctgcagtgaactattgcaccactgcactccagcctggaggacaaagcaagaccttgtctcat

SEQ ID NO: 14347 - DNA, 719 bp, Homo sapiens
tcctaaaagtatgttccttagaactatacatagcaataaacatgttttctagctatagctctgtcttggtcatcctcattccctctctgatctttccccttgctttactaaataatttattaagcaatctttaattgtagtacaaaccacatctttgtcattctttggatgtagtgtcacaaaaatatcccagtccacatcagttacacccatagataagcttacagacagaggtaagaagggagcagtgagtggggtgcaagcattggcaatattgatgggcatcctctgtcctgtactgatgacctgaggttctggacattgggaattatagcacagactcaaaataaaacatttttttgccactgtgaaaaagtgtgttgattttgtaaattaatacaaattcttcaaagacatattcagaaaaaaattccatgatgtacatgtttaagtgaaggataactgtatgtccttacatagtgctgaaatatgtagaacattatagagctcatggatataaaatttgatgttgaacattatacagtcttcttaaatgcacatcttgctgtttaatgattgtgttaaaaattgctggccaggcacagtggctcacgcctgtaatcccagcacttggggaggctgaggcgggcggatcacgaggtcaggagatcgagaccatcctggttaacacgatgaaaccccgtctgtactaaaaatac

SEQ ID NO: 14348 - DNA, 221 bp, Homo sapiens
gatgatgtaccattaactaacttgactgaaaaaaaatttggaattgattaaagatgaattttgaaaatacagtatctctggctttattttgagtaaaagttaaaaaatcctgagctggctgggtgctcatgcctgtaaatcctagtacttttggagtccaaggtaggtggatggcttgagcccaggagttcaagaccagcctgggcaacatggcaaaaccc

SEQ ID NO: 14349 - DNA, 245 bp, Homo sapiens
ttattattatttattaacttttatacagcccagagtccccaagcctcacccgtctgcccagtctagtctggcatcaaaaatggcagctggcctggccagtcagtctccagagggacatgaggctttcctggggcaggaatgtaggggctcagggttcgctgctccaggccgggaggggaggttgcggcaagtcgagatcatgccactgccctccatcctggacaaccgagtgagaccctgtctca

SEQ ID NO: 14350 - DNA, 388 bp, Homo sapiens
aaagtctttttaacatgtcacaacaaagctccatgacaggcccctctggggcatctacgtggactcctcgagggcagggactgtgtttccagcacctttgtatccccatggctcagcgtggaactcatgtgactgaatgaactcaggctctctggggctcagcacctccgtcttcttagtgaacatcaaatacagcatatctgtggtataaaaagtgtccacaggaaacaaacaaatataggatatgtcctttgccttctccacagggctaccatggtgagagccacatgcgagatacacaggaaactttgacactgtccaattctgtccattgtggggtaagatgatcaaagaagtggaaatcctcttgcccattaaagcaagttaa

SEQ ID NO: 14351 - DNA, 370 bp, Homo sapiens
ggcatctgcccttggtccactgggtgctatcacccagctgccaaccttttcctgtccacccagccccttccttgcctgaacctatctgggtagacagtatggatattgcttattggtacaacaccctatcacacccaaagcaaggtacccaggctgtaactgggaggactgggatggaatgcatgtgagacaggcccctcccgagacagccatagtcccaagagacctgctttagttgaaactctgtccccatgggacctcattgggatgaaaggttctgacactgatgtatcatgaagcttgcacaatgtggtaaagttactaaaggccactgaatcgtgcagttgaaacgagtgaattttatgatatg

SEQ ID NO: 14352 - DNA, 372 bp, Homo sapiens
ccattataggtggcatggattggaactgagaattaatatgatgggtaatagtatcaggattcagtatctcagtaagttcgattaatgagctaaacatgattaaatttaataggaataaaagcaaaattcacacttaggtcctcagtctgctaccccagggcacatcaaatgatcaattaaataaacaaactagaatttagaggcagcactttgaaaaagcctcagtaacttcactcaggttcaacaatgtgatgtggtttataggctattatagttcatctgactttcacaataagtacgtgttaatggctatgaactgattacatccactaagtgattttttgctgttaaattttctctagtgcatggcct

SEQ ID NO: 14353 - DNA, 695 bp, Homo sapiens
gtggtgggcatcactgggtcctctcttggatagcatagtcctatgaccaaatgggtcagtcgttgatcaggcttcatgagaatatgatcgctgggagaaatatacagctaatttaacaacaaatgactgtcctaattctggagacctgggaagtattgatgagagtatagtgatcataagcagacattgggtgctttagcaaagccaatttgcctgcatcctctggaaggtaaagaagatctcctctctcttagaacttaatcaaactcttggcatccacagaaggctaggaggatgtaatgaatacttaccatttttgtggaagcccacaaccttttgaatggcctttctatactttagtgaacctccatgttatgaaccttacttcctcaagtctcttttgctgctaggaggcagacagtaacttcggtaattagaaacatctgcactcagcaacatgaagcacaagttgtgtgcagttgtccatatgctgtcatgagttttgccatatgtatcatctggctttcagaggacctttcatggttgtcacgttaagttcctgatacagaagtggcatcggtgctggtgttaatggctgcagtaaagtcaaattcctagattttagtgctctgtggtagcagagagaatggtggtagtttattttttctttcctttttttttaaaaaaaaaaaaaa

SEQ ID NO: 14354 - DNA, 403 bp, Homo sapiens
agcctatacttgaatctttaatgttcatcccaaaccctaaaggtagacattacccccattttatggaaaaggacactgaggctcagaaaggtgctgtgacccggccaaggcccccttgctagtgagtgcaaagccaggactcgaactgtcccccagcttctgtctcctcctgggccaggcttcccctgagctcctccctgcccccagccctggcctgcagctgcaagggttattttcatctctcctgtcattccagcaaaaccactgggccagtgagtcagtcttgtggttaagggaggaagggtactgttgggagcccgcaatggaagacgttttttcagcgggtggcccccgggcccttgccagtacccctgcaccgagagaagagccatgttcctctagg

SEQ ID NO: 14355 - DNA, 381 bp, Homo sapiens
caaacagtacttcaagacaggcctccctccccagctcaatcattgctgcacctaagcattcccacagagaagtcccccaggtagcctggctggtgggttaatgtcagagtggtgctggctctgaacgcagctgtgggagcactgctggtatcttaggatccggtggggtggagatttggagcccaggaagacccagcctgacctggtggtggtggcttcagaaagagctggagagggtagaggcccttgcctagggctcttactgcattgtatgtaagatgaaggccacagattggtgctgtcaagactgggaaggcctgtgggactcaggaccccagggtaagactgacctgcccctcctttcacctgagacagactggg

SEQ ID NO: 14356 - DNA, 3397 bp, Homo sapiens
  misc_feature (11)..(11): n is a, c, g, or t
ggctcgagcgnccgcccgggcagtaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaatttttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaactatcatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttaagatctgctgtacattgtatatatatataatttttaaaatgcagaaagaaaataatttccctaaatataattgcaaactgatttcttttacttttttgtgtctgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagcaaaaaaaaaa

SEQ ID NO: 14357 - DNA, 3338 bp, Homo sapiens
  misc_feature (11)..(11): n is a, c, g, or t
ggctcgagcgnccgcccgggcagtaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaatttttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaactatcatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaatctgctgtacattgtatatatatataatttttaaaatgcagaaagaaaataatttccctaaatataattgcaaactgatttcttttacttttttgtgtctgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagcaaaaaaaaaa

SEQ ID NO: 14358 - DNA, 3342 bp, Homo sapiens
  misc_feature (11)..(11): n is a, c, g, or t
ggctcgagcgnccgcccgggcagtaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaatttttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaactatcatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttaagatctgctgtacattgtatatatatataatttttattttttgtgtctgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagcaaaaaaaaaa

SEQ ID NO: 14359 - DNA, 1973 bp, Homo sapiens
  misc_feature (11)..(11): n is a, c, g, or t
ggctcgagcgnccgcccgggcagtaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctcttcctaatagtggctcatttgcttgtgtgtgactcatggttgatacattatggggtctgattcagcaagggaagtttggtctgctgaaacagagaatgacacccaaggccacttcagtttctaggatactggcttgacgacaagcgtggctctgctgagaaaggaaaagctcaaaaggcgtctccatctttgggaagctgaaacgggtgtggagggaaaaagagcagcagggagcgcccttcagagcctgtgtgagatgaccatga

SEQ ID NO: 14360 - DNA, 319 bp, Homo sapiens
taatgtccgtaagttaatgcctagatttaatttagattttcatcacatagccactactcagaaaggctcagcttgtccatgatttcaacatttccttccatgaaggtctaaagagcaactcttaatacttaagcacagacagatcatacataaccaaaaaagaaggtcaagagtgcactcaataagctcttccgtcaggagcttccgatttgacagctcgtcaagttgacaagctgacacccgagcttcagagatcatctggaatgttgatgatatctgtgccctatttcaagccaagaactctaggccactagccagc

SEQ ID NO: 14361 - DNA, 527 bp, Homo sapiens
ataagagctgttttaaggaaactcagtgatctccaagataacacagaaaagcaattcagaaatgtatcagagaacctgaacagagaataaaataattttttaaaatcaaacagaaatcttggaactgagaaatatgtttgctgcactgaaatatccattagaggctctcaacagcagaatgtatcaagcagaagaaagaatcagtgagctccaagacaggctatttgtgaatacacagtcagaagagaacagagaaagaaaaagagcaaatattgactgaaagagatagaaaatatctcaaatgaccaaaactaagaattactgctgttcaggagggagttgagcaagagcaaggagtagaaagtatattcaacaaaataacagaaaactttccaaaatttaagaaagagatgaatatccagggacagggaaatcatagaacagcaaacagatttgacccaactaagactaccccaaagcatataataaactctcataggtcaaggagaaagaattataaaagcagc

SEQ ID NO: 14362 - DNA, 434 bp, Homo sapiens
taataatcatgagttacacattctgtttgctctagaaatcaagaaacagaatagtggatcatttaaggccagaaactatatccactacttgtatctcccttttgggatggttttctgatgtttttttcagtgtgtgtcatttgtataaccctggccggctgtcttgaaaatatatgtcactaatcatggtagggggtaggtgggtgagggggtcatctgattggttgtttacataaattagttgtagtgtctgttatcttcatatttaaataactgtatatgttagtataaaactccagtataaaatgggcagctggccaggtgctatggctcacatctgtaatcccagcactttgggaagctgaggcaggaggatcgtttgagctcaggagttcgagaccaacctaggcaacatgaggaaacctcatctttac

SEQ ID NO: 14363 - DNA, 180 bp, Homo sapiens
aaattctcgtaatatgccatatgttcacttacctctctgggatcctttgttcagcctccttttgtcctatgacctttctttcttattcaaattctagatctttactgattgcttcttattgcttcatggtcccttttctttcctttgcatcgtgtgtgtgtgtgtgtgtgtgtgtgtgtg

SEQ ID NO: 14364 - DNA, 137 bp, Homo sapiens
ataaacccatactcttttaaagtggtttctagggtttcggagtcagacctttgacttaactgactatgtctgttagccaaaatggataagaatggctttttaaaagaacatgttttacaggaccagaagttttgttg

SEQ ID NO: 14365 - DNA, 334 bp, Homo sapiens
agaccagattgaaataatctgggtcaggggatgaaaaccttagattaagatgaagacagagtgatttaaaaacctgaatttttaatgcagattacacttaaaaattgataaaatagaaaagggatatactaggagtgagctctcctgcatattgagaaattaaattgtgtagaaaatactgctttaggttttttcccagtcgtttcttagattaaatcagtgtatataaataaggtttttggaaagtctttttagcatgtacacatatttaaatttaaaactacttgtctttaaaaaaggattataacctgcaaacaagtttgtggttctatgt

SEQ ID NO: 14366 - DNA, 379 bp, Homo sapiens
aatgatatgcttcaaaatgttaaaaagaaatatcatttcttcagagaagacacacacaaatggaagaatatcccatgctcatggataggaagaatcaatatcattaaaatggccatactgcccaaagcaatttacagattcaatgctattcttatcaaactaccaactatattcttcacagaactagaaaaaactattttaaaattcatatggaaccaaaaaaagggcccagatagacaaagcaaccataagcaaaaataacaaagctggagtcatcatgttactcaacttcaaactatattacaaggttacagtaaccaaaacaggatggtactattacaaaaacaggcatatcaatcaatggaacagaatagagagc

SEQ ID NO: 14367 - DNA, 488 bp, Homo sapiens
aagacggagtctcgctctgttgcctaggctggagtgcagtggtgtgatctcggctcactgcaacctccgcctcccgggttcaagcgattctcctgcctcagcctcccaagtagctgggactacaggcatgcgccactacgccctgctaattttttgtatctttagtagagacggggtttcaccatgttagccaggatggtctcaatctcctgacctcatgatccacccgcctcagcctcccaaagtgctgggattacagacatgagccaccacacctggccgatgcttagtaattacaaagggaaaagtagccactttacagtacagagacctggttggactctctctgtcacccaggctggagtgcagtggtgcgatctcggctcactgcaacctctttcccgggttcaagcgattctcctgcgtcagcctcctgactagctgggattacaggcactggtggataccatcttaaccaatgatccaag

SEQ ID NO: 14368 - DNA, 429 bp, Homo sapiens
ctcttaaacgctatattgtattggcttgtttttcttacacttgccatggggttattttagaataaaatatgctatcgaatgaaatatgtgaatggactctgtaattgcattcatttgattccatcgtttaaaagctctctttttgttttgcttcctctgatgagggaagttccaaggtcatgtttattagaggcctttgaatagtttatgtaaatgagaatatcgtttaactgttctatgcaataccaataaccaatatggctattttagaccattttgttccacataactggtcttaaatagctgaaagttttctatgtaataaaccaattgcgtatgttctttaagttttgtcttaataaatcaatcactatatatttcggtcaaactcttactttgtgcttcgttcaataaaaattttctatagta

SEQ ID NO: 14369 - DNA, 416 bp, Homo sapiens
tggccccgtggaccttttaggccagatggttttttgttgtgggggctgtcccaggcctggtaggatgctgagcagcgcccctgacctctcccctcaccagccgagacagccacaactgtcaccggacattgacgaaagtcccgtagagagaaaggctcccccgcaggtgagaccactgtcctagacgattatcccggcaggtgagtttactgttacacattgcataggccgtgcaggtgatgccggagtcccgctttattcccgccttgggctgtttttgggagttctcaagccctgagttaagagctgcttacaaaactcagaggcaatcaatcacatatgttctagacccaaggccacctcagggcagaatcagcacctggaagcttccctgacgagactcgactctcaggaag

SEQ ID NO: 14370 - DNA, 3229 bp, Homo sapiens
ctcttgattacatgtatcaatttcaccagttatgacttctaaaaatttatatattttttaaaaacaagaccactattattaactaacttgaacaattgtatcatccaaaggccaaagatcatatggcagatcagggaagtcatgaagttgatttggtcttgacgtggaaaaccattaaacaacaaaagcaactgaacccatgtatgcacagaaacaatcaaacactagttcattttatagtgcccaggaaaatgttccttcttttaaaatggattttatttgaaagcgcagaaaatgaaaactagtgagatatatttttggtattataataggcaattggttgaggttcaagtttagtttcaggtaatattatcagggaagattccatgttttaaaatagtatttatggatcatgggtaggttaagaaagatgcattggcatatagtcttgatagttaagtccacgattatcattttagaatccaggctatgcttgctgctctttttatccacattttaaattacaattgcattttttacttgttcagtgcacactttgatgcaccacaagtgcattaattttgaatcgtgtgcaatatagaaatattttgagactcacaacattgaaacaaggtgacaccctagttgactttatcactaatgtgatttgaacattatttaaacaaatctagactgaacatgaaagaaaggagttttgggcagtgacatttttcacagaatgtatatctcaaaggtgaaagcagagtttttccagtgcaataaaaagaaacagaatatgcagattttgagctactcactctatagaggataacctaacacggctgaaaattgagctgggacattcagacgaaagtgacaatccatggacagaatagggaataacaggtgtgaagagaacaaacttatcactgaatgtttgcaagctggttaaggcatagccttgatggctctctagcaaactgtagaaacaatgtagctttgggtagtttcatgctttgcagaatttcttagactataaagtgacacagcctggaatataggttgataattcactataggtcttcaaaatacttatctttgaaaaccgcttctctgtttggtggggtacaatttgggggtcatttccttatgctctttcttaaatggagttttcattttgatgttagtttatgtataataggtaggatgcaaaaagatatgtaattgaaacaaaaaacattggactaaaatatcagtaattgaacatgtttatgtttgattattatttacactatggaaagatgcaattctagtactttgttaggaaactgcattaaagcagttctgccttgtataatctgtaagtacctattaagacaaaatacttctaaagatacttatgaaatgtatacacattttttcttgcacgttacaaagaaaatactcaattgcataacacggatgtttgacaaacttttttttttttaatgcatttctttctttcatgagacattgaaaccactgatagctcatttcaccctatcttaaacccttctcttgtctataaaactaatacgggtcacaccggaccttcggattaattggatccacattccccaatgatgtttgcaccccattcaagatagccatgccattgtcatttaactcgtgaacctctctttaaaactaaaatggatgtgaaagaataaaattcagtgtactgtaagtattcacagtaattctagtagaattagctgtcataacatgtttattatataatgagctggcatgacacagaaatatattttgtgtttgtatgacttttattttaaataggttaaatctggtgccactccatatatagagtgcttttgaaaaaaaatcaataaaagaaacaaaaaaaataaatgagtgaatgcaaaataagcaactgtgccttttatacctgttgttacggtaaaaaaacggttgttgggtttggacaatgaggggaaatgggctattcccaacttttttgatcctgtatatttgtccatgtttattttctgaacataataaataatatattaaaaatttgccttctgacaaactcagataaggaccagtcttaaatattgttatgtcataaagcaaagttaaggcattaatatgggctgcttaaatctgactagaagatgaaagcgtttattgtaagtgtaacacagagatactatcaggagtgaaatcagtccatttggcaaggtaaaatactgatttagagttttattctttatttcttttttgttgtgtttctttcagctatggtttcattttggttgtacagtatataaaccatatttgttttctgtacacaagactctcaagtgaattttgcatgcattatacattaggacacatttataaattaatgagtaactatataaatttatgtgtattaaaacgtctgtagcttcaatctaaaatctactgctctttctgaatctccagatatcatttctgtatggtttctgactggcctgctgcctgagtttcagaaaacaagggaggcattatttttatgggaggaggaactaagatggtactgaggatgtctgactgaaacactaccctaggaagctgtcttgtaggaaaatagaataaaacacacagaccagaagaaattgtcaagaatcaaacagccatccaaaaacagtcatgagaaatctaaagacctaaataatcttaggtatatgctctcagtgagaaataagaaaatgtgtccttaagcaaaaataaataaataaataaataaataaataaataataaaaagtgagcatgatcatgaatatagtaaatcttgtgagttgtgacctaggtgaaggtataatgataacatctggaggaagcatcatttgttcagctacctagggtttactttcagacttttcctacagtttaaagcacttgcgttcagtgtggtacgatctgtttgtaatgttaatcattgactattgttctgctacttggatgttgatagtgaagcagagaacaatttatcatcgtttattatgagtcactatgcacgcaactatgcttaacatggcgaaatgtattaaacactcgtccaactatttatgaaatactttgcataatttaatttgcttttgtacagttttatgtaaataaattgcttgtcatttttgtctctgcaaattaaaatataacatggtcaaatggttaaaaaaaaaa

SEQ ID NO: 14371 - DNA, 2411 bp, Homo sapiens
  misc_feature (2411)..(2411): n is a, c, g, or t
ctcttgattacatgtatcaatttcaccagttatgacttctaaaaatttatatattttttaaaaacaagaccactattattaactaacttgaacaattgtatcatccaaaggccaaagatcatatggcagatcagggaagtcatgaagttgatttggtcttgacgtggaaaaccattaaacaacaaaagcaactgaacccatgtatgcacagaaacaatcaaacactagttcattttatagtgcccaggaaaatgttccttcttttaaaatggattttatttgaaagcgcagaaaatgaaaactagtgagatatatttttggtattataataggcaattggttgaggttcaagtttagtttcaggtaatattatcagggaagattccatgttttaaaatagtatttatggatcatgggtaggttaagaaagatgcattggcatatagtcttgatagttaagtccacgattatcattttagaatccaggctatgcttgctgctctttttatccacattttaaattacaattgcattttttacttgttcagtgcacactttgatgcaccacaagtgcattaattttgaatcgtgtgcaatatagaaatattttgagactcacaacattgaaacaaggtgacaccctagttgactttatcactaatgtgatttgaacattatttaaacaaatctagactgaacatgaaagaaaggagttttgggcagtgacatttttcacagaatgtatatctcaaaggtgaaagcagagtttttccagtgcaataaaaagaaacagaatatgcagattttgagctactcactctatagaggataacctaacacggctgaaaattgagctgggacattcagacgaaagtgacaatccatggacagaatagggaataacaggtgtgaagagaacaaacttatcactgaatgtttgcaagctggttaaggcatagccttgatggctctctagcaaactgtagaaacaatgtagctttgggtagtttcatgctttgcagaatttcttagactataaagtgacacagcctggaatataggttgataattcactataggtcttcaaaatacttatctttgaaaaccgcttctctgtttggtggggtacaatttgggggtcatttccttatgctctttcttaaatggagttttcattttgatgttagtttatgtataataggtaggatgcaaaaagatatgtaattgaaacaaaaaacattggactaaaatatcagtaattgaacatgtttatgtttgattattatttacactatggaaagatgcaattctagtactttgttaggaaactgcattaaagcagttctgccttgtataatctgtaagtacctattaagacaaaatacttctaaagatacttatgaaatgtatacacattttttcttgcacgttacaaagaaaatactcaattgcataacacggatgtttgacaaacttttttttttttaatgcatttctttctttcatgagacattgaaaccactgatagctcatttcaccctatcttaaacccttctcttgtctataaaactaatacgggtcacaccggaccttcggattaattggatccacattccccaatgatgtttgcaccccattcaagatagccatgccattgtcatttaactcgtgaacctctctttaaaactaaaatggatgtgaaagaataaaattcagtgtactgtaagtattcacagtaattctagtagaattagctgtcataacatgtttattatataatgagctggcatgacacagaaatatattttgtgtttgtatgacttttattttaaataggttaaatctggtgccactccatatatagagtgcttttgaaaaaaaatcaataaaagaaacaaaaaaaataaatgagtgaatgcaaaataagcaactgtgccttttatacctgttgttacggtaaaaaaacggttgttgggtttggacaatgaggggaaatgggctattcccaacttttttgatcctgtatatttgtccatgtttattttctgaacataataaataatatattaaaaatttgccttctgacaaactcagataaggaccagtcttaaatattgttatgtcataaagcaaagttaaggcattaatatgggctgcttaaatctgactagaagatgaaagcgtttattgtaagtgtaacacagagatactatcaggagtgaaatcagtccatttggcaaggtaaaatactgatttagagttttattctttatttcttttttgttgtgtttctttcagctatggtttcattttggttgtacagtatataaaccatatttgttttctgtacacaagactctcaagtgaattttgcatgcattatacattaagctgatcctggccggccggcn

SEQ ID NO: 14372 - DNA, 692 bp, Homo sapiens
ctaatgctatccctcccccagtgcccagccccccgacaggccccggtgtgtgatgttccccaccctgtgtccaagtgattccattgttcagttcccacatatgattgagaacatgtggtgtttggttctcgctgtcctttttataaagccccagtgtctcgattatttttgctttgcagcaagtcttaaaatcaggtacacagtgtgggtcttccagctttattcttttatagaattgtttgagtatttaaggttctttgaccttccataaaaatgttagaatcagcttgtccatatctccaaaaaactcttgccaacattttggttggaattgatattaaattttagatcagactggggagcattgactgtatatgtagcatcttagcaatataaagttgccaacacatgaacatattatgtctctccaactacttaggtctttgattaagaaaaaaaaatcagcattttgtagttttcaacatacctttaataagttgtgttagatttaatcctatatacgtatgtgtttatttgggggggctattgtgaatggtctatatgtacacataagtgcatatgtatagatttcctttatttaaaattcccattgttaattggtttggggggttttttgtttgtttttgttttttgagacagggttttactctgtcactcaggctggagtgcag

SEQ ID NO: 14373 - DNA, 1048 bp, Homo sapiens
ggtgaaccagacagggagcagacgggaggatgcttcagaaatccaggcatctggggagtagttcccagtagactttggaatggagggtgatgcagagactaacgtgttggagtgtgcaaaccagagactagtaataagtgaaactgatggcgagatcttgacaccagggtgggacacccaggaccggatgggagttgagagtagaaccaacattcaggaactagggaatagaaaccagagggaggctggaggtgagaatctccctgaaacccaggcacatatgggagagaaccaagaacagttaagatgtaaaattgatgcagagacccaaacacctgagtgggagaaccaggataagaatggaagtgaggatgctgtggagacccagacatttgagaagaaggacaagaaagaggctggagaggaggatggggaagagatccaggctcaaggattggggaagcaaggccagactggagatgagaatggtgaggagacccagacaccacagtgggagaaacaagatcagatgaaaggtgatgcggatgtggaaattcagatggaagaggggagaaacaaggatcaggttggaggtcaggatgctgcacaaacccaatcatgtgggagggagaacgtgggagaagtaaaaaaagagaatagtgtagagacccaggccttggattggggaaaacaggaatgtgttggaaatgggaatgttacagagatccagacaccaaggtgggagaagcatgatcaaggtggaagtaagaaagctaagaagacccaagcatctgggggagagaaccagaaacaattaagtcatgaaattcaagtggggtggggaaataagggcctgagaagagatgaagatgctaaggaaacccagatagctaccaagaagaagctcagggagataagagaaggattgggtggtgatccaggcactatggtggggaaaccggagacaagtagcaagtgaaatttatagagaatttgagatactatgttgggagaatcagaactggattggaggtgaacatagagcaga

SEQ ID NO: 14374 - DNA, 2856 bp, Homo sapiens
aggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatggtgcacatacccagatatctgagtcagggaactggggcaaattaacaagtcaaattgatggagaaatgcattcagcagaatggaagaaagatcagcagattggaggtgagaatggggcagaaattcagatacaagggaagagaaacctgagagaagttggaggtgaggacggtgtaaagacctgggcacctgggaaagaaacccagagtcagtttagaagtgatcttggtagaaagatccttttatcagagtggaagagccagaagcagatgggaagtgagaatggaacagaaattcaggctccagtggagagaaaccagagagaacctggaggtgaggacggtgtaaagactcagagacctaagagagagaacgaggaccagttagatagtgaaattggagggagccattcaccagggaggaggaactgggagctgattggaaaggatgttgcagaaaatcaggcatcagagaagagaaaccagagagaggttggaaacgaggacggtagaatgatctggaggcttaggggaaaaaactggaggcttagagcgaagaaacagactgttaaaaagtaaagataatggaaagacccgtttatcagagtggaagagaaacctgagagggaccacagctgatgatggtacagagacccaggctcctgcaggagatgaccagggacagttaagagttgaaattgatgaagagatccaggtacaagggcaaggaaataagaatgacggtggagttgaggatgttgcagaactccaggatataggaagccagagaaagtgcacagatgaggatgttggagagcctcgagcaccaaggggaggaaacaaggatctggtcagaggagaggatgctgtgagggacagtctccaagtcgactgttctgggagtgagaggcccacaggcaggaagcacagcctaccatggcctccagccttcactggctatggatgtgggacccgggaacaggaacaggcagtggctgtgaatggtttcatctctgccccctgtcctgagatgaatcctgtcccccactggggtgaagtcttcctgctggtgggtggggagggagagcatctggccagccagggcacaacccctgccagggatcatagagtggggatcagtccagcctcccagcaggcccaacctgaatcctggagaagacgacaaagggacaaaggggtggatccagagaaggcccccagcctgactcggcagtcccaaaaccctccgtctctgacagctcccttgggcatgccctctgcctgctcctgtctcccgtgtggcccagccccggaagctgccatcattctagcgggtcctcccaccgccctcactgtcctgcccaaggggacaggcctcaagaagagcaaacgactgctcctggagtccctcatgcggaggaggattgcacacctgaagtggggtcttccccggcggatcctggagtcctatttcctgtttaacttcttaggatcttgctcattgacccttgctggggcgaggctctctggactgaacacaggccaggagctccaagcccagcaggaaaggtattgtgaggcccaaggctccccaccaggccttaagtccccagagaggttccagagggttcagcgcccagacagaaaaagctcgaaacttcctatacaagccagagctctggagaggaacagaccgcacatgtcagagcccattaagcatttccatccagcctgaaaaggccaggagagtcaggccaccagggggcgccagagaaccacaggagatccaggaagcgcttgctaggaccaagctcccagctcccaggacccccaggccggcagcggagtccaggagctggtgtggcccacaaagggtcggagagcctcccagtgagaacagtaggggcaggaaaatgatcaggtcaagggtctcccagctggcagagagggctcccagcagagtgaggacttcattctctagggcagaccacgcccactggaggaaggaatgtacatcctgggaggcctctaagctccccagactcaaatgccagcagctcacatactggagaagaggaagcctggaatctacagggtgcagaggggctgggcagcagccttcctgccattctgcagaacctgtcagcttcaaagggaggctccactctgcggtggcaaagctgggcctgacccttctggccaagatgtcctggtccccacagctcgccaagcgcaagcacttggcccctaacctgagcctgagggaacctgattctactctgcctcccaaagtgggtgatcctcgtgcaggggaggacagcatcggagatcacactgcttcacagagggatcttcagctgcaaggtcactgctgtactggggccacccttcctaagacagagagtccccagggccaggaggcacctgggaacccaaatggggctccacagaatacacgagcctccaaaaagtttagtattatgaagcatctgaatttttttctcttccagaatggctttaaaaagtagactcaggcccagagtcctcaggacatatcagaaaagctttgagagtgtcctgatccctgcaaagcctctaataaattggtcatttgggc

SEQ ID NO: 14375 - DNA, 2951 bp, Homo sapiens
aggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatggtgcacatacccagatatctgagtcagggaactggggcaaattaacaagtcaaattgatggagaaatgcattcagcagaatggaagaaagatcagcagattggaggtgagaatggggcagaaattcagatacaagggaagagaaacctgagagaagttggaggtgaggacggtgtaaagacctgggcacctgggaaagaaacccagagtcagtttagaagtgatcttggtagaaagatccttttatcagagtggaagagccagaagcagatgggaagtgagaatggaacagaaattcaggctccagtggagagaaaccagagagaacctggaggtgaggacggtgtaaagactcagagacctaagagagagaacgaggaccagttagatagtgaaattggagggagccattcaccagggaggaggaactgggagctgattggaaaggatgttgcagaaaatcaggcatcagagaagagaaaccagagagaggttggaaacgaggacggtagaatgatctggaggcttaggggaaaaaactggaggcttagagcgaagaaacagactgttaaaaagtaaagataatggaaagacccgtttatcagagtggaagagaaacctgagagggaccacagctgatgatggtacagagacccaggctcctgcaggagatgaccagggacagttaagagttgaaattgatgaagagatccaggtacaagggcaaggaaataagaatgacggtggagttgaggatgttgcagaactccaggatataggaagccagagaaagtgcacagatgaggatgttggagagcctcgagcaccaaggggaggaaacaaggatctggtcagaggagaggatgctgtgagggacagtctccaagtcgactgttctgggagtgagaggcccacaggcaggaagcacagcctaccatggcctccagccttcactggctatggatgtgggacccgggaacaggaacaggcagtggctgtgaatggtttcatctctgccccctgtcctgagatgaatcctgtcccccactggggtgaagtcttcctgctggtgggtggggagggagagcatctggccagccagggcacaacccctgccagggatcatagagtggggatcagtccagcctcccagcaggcccaacctgaatcctggagaagacgacaaagggacaaaggggtggatccagagaaggcccccagcctgactcggcagtcccaaaaccctccgtctctgacagctcccttgggcatgccctctgcctgctcctgtctcccgtgtggcccagccccggaagctgccatcattctagcgggtcctcccaccgccctcactgtcctgcccaaggggacaggcctcaagaagagcaaacgactgctcctggagtccctcatgcggaggaggattgcacacctgaagtggggtcttccccggcggatcctggagtcctatttcctgtttaacttcttaggatcttgctcattgacccttgctggggcgaggctctctggactgaacacaggccaggagctccaagcccagcaggaaaggtattgtgaggcccaaggctccccaccaggccttaagtccccagagaggttccagagggttcagcgcccagacagaaaaagctcgaaacttcctatacaagccagagctctggagaggaacagaccgcacatgtcagagcccattaagcatttccatccagcctgaaaaggccaggagagtcaggccaccagggggcgccagagaaccacaggagatccaggaagcgcttgctaggaccaagctcccagctcccaggacccccaggccggcagcggagtccaggagctggtgtggcccacaaagggtcggagagcctcccagtgagaacagtaggggcaggaaaatgatcaggtcaagggtctcccagctggcagagagggctcccagcagagtgaggacttcattctctagggcagaccacgcccactggaggaaggaatgtacatcctgggaggcctctaagctccccagactcaaatgccagcagctcacatactggagaagaggaagcctggaatctacagggtgcagaggggctgggcagcagccttcctgccattctgcagaacctgtcagcttcaaagggaggctccactctgcggtggcaaagctgggcctgacccttctggccaagatgtcctggtccccacagctcgccaagcgcaagcacttggcccctaacctgagcctgagggaacctgattctactctgcctcccaaagtgggtgatcctcgtgcaggggaggacagcatcggagatcacactgcttcacagagggatcttcagctgcaaggtcactgctgtactggggccacccttcctaagacagagagtccccagggccaggaggcacctgggaacccaaatggggctccacagaatacacgagcctccaaaaagtttagtattatgaagcatctgaatttttttctcttccagaatggctttaaaaagtagactcaggcccagagtcctcaggacatatcagaaaagctttgagagtgtcctgatccctgcaaagcctctaataaattggtcatttgggcaaaaaaacaccaaaacacactacaacaaaccaaccccaaacacaaaacaccacacccccaacacaagggggggcgcgccaacaaaaaccaccggg

SEQ ID NO: 14376 - DNA, 1046 bp, Homo sapiens
aggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatggtgcacatacccagatatctgagtcagggaactggggcaaattaacaagtcaaattgatggagaaatgcattcagcagaatggaagaaagatcagcagattggaggtgagaatggggcagaaattcagatacaagggaagagaaacctgagagaagttggaggtgaggacggtgtaaagacctgggcacctgggaaagaaacccagagtcagtttagaagtgatcttggtagaaagatccttttatcagagtggaagagccagaagcagatgggaagtgagaatggaacagaaattcaggctccagtggagagaaaccagagagaacctggaggtgaggacggtgtaaagactcagagacctaagagagagaacgaggaccagttagatagtgaaattggagggagccattcaccagggaggaggaactgggagctgattggaaaggatgttgcagaaaatcaggcatcagagaagagaaaccagagagaggttggaaacgaggacggtagaatgatctggaggcttaggggaaaaaactggaggcttagagcgaagaaacagactgttaaaaagtaaagataatggaaagacccgtttatcagagtggaagaaccaggaacagggtggaggtgggaatgatgaagaaattcaaatacaggggaagcggacgatgactatgtagagactggtcaagcccctttacaggatttgagcccatccaaaaaaagagctgtccagcgactaggggatggagccaatgccgtgcgagcaaatcccttgtcgctagcgccgtacaagcaaggg

SEQ ID NO: 14377 - DNA, 720 bp, Homo sapiens
ggtgaaccagacagggagcagacgggaggatgcttcagaaatccaggcatctggggagtagttcccagtagactttggaatggagggtgatgcagagactaacgtgttggagtgtgcaaaccagagactagtaataagtgaaactgatggcgagatcttgacaccagggtgggacacccaggaccggatgggagttgagagtagaaccaacattcaggaactagggaatagaaaccagagggaggctggaggtgagaatctccctgaaacccaggcacatatgggagagaaccaagaacagttaagatgtaaaattgatgcagagctcgccaagcgcaagcacttggcccctaacctgagcctgagggaacctgattctactctgcctcccaaagtgggtgatcctcgtgcaggggaggacagcatcggagatcacactgcttcacagagggatcttcagctgcaaggtcactgctgtactggggccacccttcctaagacagagagtccccagggccaggaggcacctgggaacccaaatggggctccacagaatacacgagcctccaaaaagtttagtattatgaagcatctgaatttttttctcttccagaatggctttaaaaagtagactcaggcccagagtcctcaggacatatcagaaaagctttgagagtgtcctgatccctgcaaagcctctaataaattggtcatttgggc

SEQ ID NO: 14378 - DNA, 2691 bp, Homo sapiens
aggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatggtgcacatacccagatatctgagtcagggaactggggcaaattaacaagtcaaattgatggagaaatgcattcagcagaatggaagaaagatcagcagattggaggtgagaatggggcagaaattcagatacaagggaagagaaacctgagagaagttggaggtgaggacggtgtaaagacctgggcacctgggaaagaaacccagagtcagtttagaagtgatcttggtagaaagatccttttatcagagtggaagagccagaagcagatgggaagtgagaatggaacagaaattcaggctccagtggagagaaaccagagagaacctggaggtgaggacggtgtaaagactcagagacctaagagagagaacgaggaccagttagatagtgaaattggagggagccattcaccagggaggaggaactgggagctgattggaaaggatgttgcagaaaatcaggcatcagagaagagaaaccagagagaggttggaaacgaggacggtagaatgatctggaggcttaggggaaaaaactggaggcttagagcgaagaaacagactgttaaaaagtaaagataatggaaagacccgtttatcagagtggaagagaaacctgagagggaccacagctgatgatggtacagagacccaggctcctgcaggagatgaccagggacagttaagagttgaaattgatgaagagatccaggtacaagggcaaggaaataagaatgacggtggagttgaggatgttgcagaactccaggatataggaagccagagaaagtgcacagatgaggatgttggagagcctcgagcaccaaggggaggaaacaaggatctggtcagaggagaggatgctgtgagggacagtctccaagtcgactgttctgggagtgagaggcccacaggcaggaagcacagcctaccatggcctccagccttcactggctatggatgtgggacccgggaacaggaacaggcagtggctgtgaatggtttcatctctgccccctgtcctgagatgaatcctgtcccccactggggtgaagtcttcctgctggtgggtggggagggagagcatctggccagccagggcacaacccctgccagggatcatagagtggggatcagtccagcctcccagcaggcccaacctgaatcctggagaagacgacaaagggacaaaggggtggatccagagaaggcccccagcctgactcggcagtcccaaaaccctccgtctctgacagctcccttgggcatgccctctgcctgctcctgtctcccgtgtggcccagccccggaagctgccatcattctagcgggtcctcccaccgccctcactgtcctgcccaaggggacaggcctcaagaagagcaaacgactgctcctggagtccctcatgcggaggaggattgcacacctgaagtggggtcttccccggcggatcctggagtcctatttcctgtttaacttcttaggatcttgctcattgacccttgctggggcgaggctctctggactgaacacaggccaggagctccaagcccagcaggaaaggtattgtgaggcccaaggctccccaccaggccttaagtccccagagaggttccagagggttcagcgcccagacagaaaaagctcgaaacttcctatacaagccagagctctggagaggaacagaccgcacatgtcagagcccattaagcatttccatccagcctgaaaaggccaggagagtcaggccaccagggggcgccagagaaccacaggagatccaggaagcgcttgctaggaccaagctcccagctcccaggacccccaggccggcagcggagtccaggagctggtgtggcccacaaagggtcggagagcctcccagtgagaacagtaggggcaggaaaatgatcaggtcaagggtctcccagctggcagagagggctcccagcagagtgaggacttcattctctagggcagaccacgcccactggaggaaggaatgtacatcctgggaggcctctaagctccccagactcaaatgccagcagctcgccaagcgcaagcacttggcccctaacctgagcctgagggaacctgattctactctgcctcccaaagtgggtgatcctcgtgcaggggaggacagcatcggagatcacactgcttcacagagggatcttcagctgcaaggtcactgctgtactggggccacccttcctaagacagagagtccccagggccaggaggcacctgggaacccaaatggggctccacagaatacacgagcctccaaaaagtttagtattatgaagcatctgaatttttttctcttccagaatggctttaaaaagtagactcaggcccagagtcctcaggacatatcagaaaagctttgagagtgtcctgatccctgcaaagcctctaataaattggtcatttgggc

SEQ ID NO: 14379 - DNA, 385 bp, Homo sapiens
ttgagaaagggtctcactctgtcacctaggctggaatgcagtggcgtgatcacgactcactgcagccttgacatccgtaggctcaagtgatcctcccatcccagcctcatgagtatctgagactacagacatgcgccaccatgcctagctaatttttttgtattttttggagacggggttttaccttgttgccccaagctggtttcgaactcctgggctcaagtgatatgcctgctcaagcctcccaaagtgttgggagtacaggcgggagccaccatgccctgcaacagacatatctttatttacatccagctctattagtgattgcatcctttgattggtagcagctttgagaaaattgtgaggcctacatttgggctgagaa

SEQ ID NO: 14380 - DNA, 432 bp, Homo sapiens
gctacctcacttccttttgctcctgcctattttctgagctggcactttaaacttcctggagattttatgagctactctagtttctttcaaccaatttcttttctacttgctatggactgaattttgtcatctctctactcctccattcatatgttgaagtcctaacccccagtgtgactatatctggaggtaggatctttggaagtaattaaggttaaatgaggtcataagagtgggaccctaatcagataagaccaagactttataggaagaggaagagagaaagagaaacctctctctttcatgtgaggatgcagcaagaaggcagctgtctgcaagccagggacctcaccagaaaccaaaccctgtcaagccttgattgtggactttccagccttcagaatgtgaaaaataaatttctgttatttaagc

SEQ ID NO: 14381 - DNA, 463 bp, Homo sapiens
agttgtctcagaatcatcctccgttgacatctccatctccaggacagctccacactaatctgtttcaaagacaaaatccagtctaatcagtttgatgtatgtttctgggaatagagccgaatgttgtagctgatggaatggagtctcataccattgattttgcagctggacaagtgccctgccatgttactgccactctttaaggcagaatagagcacattgtatcatttataggcctctcacagtgagaaatatgtggaactttggaaatcagaatctaaaactgcagtccaatggggtagccactattcacatgtgctattgagtacctaaaatgtggctagaccaagttgacatgtgctgaagggtgaaaaacaccaggagtgaagaattaacttgaaaaaaatgtaaactatctcaattttatattgattacaaattaaatgatgttttgaataaaaaa

SEQ ID NO: 14382 - DNA, 447 bp, Homo sapiens
agaaagaaagaaaaaagtaatgggaagtaatagtaaatgtggatccagaaagaaaaacaaaggttaagaaaatgatgtatgtgaaagaaaaaaagctctataatcagtgtgtttctctcacctaaaacaccatttactaactacttggttcagttgtaccctttaactctattttgtccttgacttatatcaacactcttcttttccaaactcctatagctctccatctggaatgattctatggggtggggggtcgggggaggagaaagggagacagcagaagaaagaaagagagagaaagatagagagagagagagagatgggtggagacttggcctctctcctagaggttcaaagttagaatatgccactaacactatctgcctttcaaactcccttctaggacatgctccatagtacttagatcttatatcaaatgacaaggtt

SEQ ID NO: 14383 - DNA, 796 bp, Homo sapiens
actggactggatccatgattggattggatctgataattaactgacttggattcagttaagaggctgcagatgtccaggatcaggcagaaactagcagaaatggtaatattacagtgggtgcagacttcagaaatttgcagagatttttgtgttctacattctttttcttgtacccttaggtagggaaaaatcattaactaaattgatgaaggggatctgaggaccaaatccaggattctagggaaatattggatccttagtatctgaagaacaccgtattctaccttctagctataaggtagaatgtataaatattaggcctcagaagaaataactacttacagaaatggcaaaatctttgtaacttaaaattacaatggaccgttcctaatgaacaacacagcacttaaaaatgaggggtcctgaattagtcttcaaggatgcctattgatgtgcagaagcttctaaaaacatttcaatatttttattgctttattaaaagacttcataaaaggcaaatagggccaggtgtggtggctcatgcctgtaatcccaacacgttgggagatcaaagcaggaagatcgcttgagcacagcagttcaagacaagcctatgcaacatagtgagatctcctctctacaaaaaattaaaaatcagctggatgtggtggtgtacacctgtagttccagctactcaggaggctgaggtgggaaattcacttgagcccaggaggtaaaggctgcaaatcagctgtgactgtgcctttgtgattacacagagggaaaccctgtcttt

SEQ ID NO: 14384 - DNA, 485 bp, Homo sapiens
gtgctggtgggacgtgggtctctgcagctgggctgggaggctgcacgtgggcctgatgggttcttactgagagcctgggctgactctgacagctcttgtggccaccagttaacttcaagaggactccaggagatggaaagaccaaatagtttggggggcagggcttgtgctaggaccaagttcatccatcactgctgtgggaacgtatggctcatgattcaccagtggtgtgcggcatgaaagctgggtaccttgctgggaggtcccttgttctttcctccttccagaagcttcccacctatcttcatccacattcgtccaataggttgtatttcacactctcagccgatggctttaggcacaagctttgtgtgggtcactctggttagagcattttacacaccctcatgtcaagaagatcaggtcagtgatatcttttcactccactctttagacaccacataatggaactgaaatcttattag

SEQ ID NO: 14385 - DNA, 483 bp, Homo sapiens
ccaggatgaaagttttaattttaaaatgcaaattgtacaagatatttaattgttgaaataacatacaagacattctggatgtagaatgttaagtctatattagaaaagaattttttttctatttttagccatagaaattttttccatatttgtttctttttcaaatgctattgtcatgagtagatatccatgtcttttttctgagatttctaattttaaaatgcattgctcatttaactattctaaattatcataggcacatcaaggccattgaaatgaaaaaataaatggtattaagccttaatcatttacaaagaagaatgctctcttaatctgctataatgaacatgtacatggaattaatgaatattcacacttcttccaaatgtatgtaaataagattttgataaattagacaaaaatatatgacattccataccatgtcattttataataagcccactacttttatacagtgctgta

SEQ ID NO: 14386 - DNA, 299 bp, Homo sapiens
caacactttagagtaacggaagcatgttaaagccattggaaaatttgaaggcaaaagtacatctttagtcagtgtgctgattgctcccttgagtagagcagaatttctcacctctgaaaatatatgaaagtgccatacatactgttctgaactcacagaataatatgaacaacttattaaaaacattcagtgaatgaaaagagtatttcttatcactgtttaatattttgagggagttaaagaagtataacgacatttactctcaaagaatttacagtctggttgaggattcaaggcat

SEQ ID NO: 14387 - DNA, 424 bp, Homo sapiens
acaagtaacacaatacacagtggaacagtattcagccttttaaaagaaggcaatcctctcactcactgtaacatgggtgaaccttgaagacattatgctaagtgaaataagtcaaccatgaaaagacaaatctgctaactctgcttgtatgaggtatctcacacagtccaactcttagacacataaagcagaatggtggatcccaggggctggggtggggaggaggcagttttgttcaatggctatggagtttccggtttgcaagatgagagggtcatggtgatatagatggtatgactgtactgtgtgcttacggaacggtgtctacgctataaatggataaagtggttgctgtataaaatggttgatggcaaattgtatacatatataacagtatctttttaaattaaaaaatgttaacaaa

SEQ ID NO: 14388 - DNA, 458 bp, Homo sapiens
caggtccccaaagaatttctgcaggctgggactcctgagtgaaatgaagaagtgggattcaacagagagaaatgtgaagtctgccagctagccctgagaagcaggcatgacaagagaggatgcccgtgttacagatgagaaaaacagaggccctgggaggaagcttgcctaatgccactcaggaggtagaggcaaagctgggaaaggccctgggtccccagactgcccctctggaactccacatgcagccacctggctgtcctgcccgggatgccatccgcaggctaggctggcgctcatgcccatgccctgctgtccactgacaccccgcagagcttaacaccccgctgagcctgccctgcagcccttgccaagtctgtccgagtggcctcagtcattggcaagtcacattgctgacatcgcaactgcataaaattaatttatttagttaagggagg

SEQ ID NO: 14389 - DNA, 393 bp, Homo sapiens
cactcttccttttaattttcttcttcaatttttgtggatatcttcatttgcttccatcttctgtaatgttttctttgtttctctgtgttatactttattattatttatttgcttatcatgctctagcctcattttaattggcttccaggggagactagagataaacatatgtgttcagactattatgcttaacctgaagtctgtaacatttttcaataaacacttttaaaattcagaacatttattcagtgcctactatatgtcaagctcttggctgagaagctgctccttgaatttttagtgtttacaatgattattgaaaatatatttcaggcttcattaaaccaagctccttatgtatttctgccaagtaataaatatattaagtaagtg

SEQ ID NO: 14390 - DNA, 189 bp, Homo sapiens
ctatacatattgatggatatatggatatcaataggaagatacattaactagactatagaacttgggtcatttttattttccttatagctttcattttattttccaagtttttctacaatgaatataaacttctataatcagaaggaaatgtcttctcacatatactccctcttttaaaaagggtccatg

SEQ ID NO: 14391 - DNA, 464 bp, Homo sapiens
aaccaatgcatactatttcattttacaaatataaattaatgtacctatcaatcctctattgatggtcatttgtttaccattttttgctgttgtaaatcttcagtgaggatctttatacagatattcttgtacatttatgagaatgcctgttgaatacattcccacaagagaaattattggatgaaatagtacatgcaatttttagttttcaaaatgccagactttctgaagagttgtgacaactaccaccagcaaggtctgaggcattctttttcacattcttactgacatccagttttgtcaaacttactttttgccaatcagatgggtaacaggtgttacctcattttaatttgcatttctttggataatgagagaaggaaaccgtctcttcttgtccatttatatttgtttttgtgaatctgcctagtcgggttctttgtccatatgtatattgcatttcc

SEQ ID NO: 14392 - DNA, 344 bp, Homo sapiens
gtatccaacctgaccttattcatagtcaggacagtgttgtgagttcaagaacagagagtagctgccaaaaataatgatcttttctgtgttctctgatcctgggaaggggtgagtggctctagtttccctctaacatcctcctctctctctctctctctgtgtacatgtgtgagtgtttgcttatgcaagaaaggaaggaagaggaccgagctggtgcaaagccagcttctctcagggtatctttcttccataccatctctacttcctcagaatccttgatctgccaaagagaaatccggaaaatgatgaaatggccatttcacttctatgtgttttgaatgcaa

SEQ ID NO: 14393 - DNA, 453 bp, Homo sapiens
gtaaaaactgggatcatcttttccttgaacgtgttgtagaatcccctggaaaaccttcgtggcctggttttattgtatgtgtgtattcggtatttattgttgcataaccagtaccccagatcttggtggtttaaaacaataaaatacattacgtcacagtttctgagggtcaagaatttgggagtagtttagttgagtggctgtggctcagggtctgtcatgaggttgccatcaaaatcttggctggggctctaatcatcatgactgcggctggaggatttgcttccgacatatcccgctcacgctgttggcagttccctggtggctcacggcaggcagccttgggtccttgccatatggaccccttgagtgtcctcatgacatggcagctggcttccccctttcgttcttcaaagaattgtggggtttttggcttttttttttataagatct

SEQ ID NO: 14394 - DNA, 488 bp, Homo sapiens
tgaagtcttagaattgagatgctttttaagggaagcttttgtcctgggaaaatgatacctctaatatttaagatgaggtagtatctaagtctattctaaacagttttttgttagaatgatttttctttgttgtaaaaagttgttaatcagccgcctattgtgggttgttaacatctcaaaagggtgtttaaaaataataaaccccaattgctcccaacaattaaccttgggaacaaaagtaaatgtgaatgcttcttaaccacctttctaagccctcagtgaagctggcagccatcagttaaataaaccattaagtttattagtttaagaatagaagtgtcaacttggacacagttttctaatttgctcctcatttacccaacaatcatttattcaaaggctgctctgcctagtagactttagataaatctacaaataaaagccagagactgatgggcagctggaactctaagggaatcatccaaatg

SEQ ID NO: 14395 - DNA, 515 bp, Homo sapiens
ttgctttagatttcacactcaggcagcgacacacagtagctaagagactagacttggtcagacagaatgggaatctggtaggttttaccacttactaacccacataacattgggaaagtaacattagctaattgttaattactaaggcactgttcaaagtgcttaacttgaatgaattcatttactcctcaaaagtccctatgagataggatcctataaatgaggtaactgaggtaaaaacagtaagtaatatactcaagatcacagagctggtaaaataaagaactgagaataaactcaggtagccctgttgctaaagcctatattcttaaccacttcattggtggtttttaaaaaatttaaatacaacccactccaagaagtaattttttaagggctgggtgtggtggctcacacatgtaatcccagcactttgggaggctggggtgggcagatcacctgaggtcaggagttcgagaccagcctgaccaacatggagaaatcccgtctctaca

SEQ ID NO: 14396 - DNA, 468 bp, Homo sapiens
gaagtcaaactgggggttagtattgggaagctgaaattcaccactctctagagttcttcagtgaagtaacacactttgaagagcactgactggtcaggccaggctcctgtgtagtaagatgaggggactcccaaatgactgctgattcactttccgtagaacagatgcaagacttcccctgggtttgctgagtctttatctagggttggtttttgttgtcttttatttttaaactctgcccaacgggctgttttgatctcagaagagtttgaaacaagtttcccaggcatgtatccccatttacagtgtgcccagattccgtcctagatcgctcacatatcaccctacctctccagcctgctttctctagcagcagaccccagcacttcccagtgcccatggggctttaccgcaactgccgccagctcttccctgcacccatcccctccatgccctcccttccctcgc

SEQ ID NO: 14397 - DNA, 484 bp, Homo sapiens
agataataagtgtgtgtggttttaaagcattaaatatgtggtaatttgttatgcagcattagaaaatacaagcagtttagagcctaccatggaaaatgcaatagcccatatgacatataaaacaaggtggagaagcatttacttgcttgaattcattttaggaaaagtacttgtttggggggaataaaagtagagagactttgttgaatgagccccagggctgcccccaaggctactgtacaaccaaaaagatgatggtgtttttttattaagagaaagatgtatgcttatgggtattccagagatcatcaagattttgagtgcttctccccctggcacatgctcccttgaagtttgcatctcactcttgctttgctctgatctgtatcacatagggaagatggctctttgaatctgcttcttgctggataccactaataggaggcactggaaggagattggagtggaagggtgataggggaat

SEQ ID NO: 14398 - DNA, 376 bp, Homo sapiens
aaagacagatttataagggaaaagcaaacaagtttattaatgcgtgccgcacaccacacaagaaaccccaaggaaaagtaactcaagggctgatcacagtggcttatgcctgtaatcccagcactttgggaggctgagttgggcagatcacttgaggccaggagtttgagaccagcccagccaacatggtgaaaccccatctctattaaaaatacaaaaattagctgggcttgatgatgcacacctgtaatcccaactcaggaggctgaggcagaaatattgcttgaacctgggaggcggaggttgcagtgaaccgagattgtgccactgcactccagcctgggtaacagagcaagactatgtctcaaaaaaaaaa

SEQ ID NO: 14399 - DNA, 333 bp, Homo sapiens
atgaaggaaattcacacatgaacctgagactcttccttgtcaatgaccattttaaaacccaggcagtcacaaaactttattatggaataaaggatgggtttggataacaagatgatgcttttaaaagaaaacaatttaatcttgatatttttctttatgatgagacagaaaattttattgttataaataccagtctacaggaccaatgttaatatttttagatttgttttatggtgaatagaagtgaaatataatatgtttagaaaaatattttatgtttttaaatattgggaaactttgcctttttaaaacaccattatttagaaagaaaat

SEQ ID NO: 14400 - DNA, 708 bp, Homo sapiens
actcattacctttgaaccaacctgggaggcagccttgtgactcacctcaatcctcaatcttctcagctagttcactttggcctggctcaggggctgacctagaatgatcctgtccagaaggaccctggatgttcttagagacacagactgctagggctggcagggacttttcatccaattcctctgtgacagaggaggaagtggaggtgcagaaggagaggtgagctgcctgtggtccttcagcttactaatggcagtgttaggactggacctgagggctcttccctccagtccggcgctatttattccatgacagtgcctctcaaactgtgttctcacaagcagctagtgctcaggcagctggactgaggccctgcctgccaaatcaaatattggaggtctttctccaatgtgcagaaaaaaaaattaattaatgggttaagtttccttagggttaaattatttttccattaatgcttcttaaaccattgtcacctgctaccaattgtctactagccaatgcatgcaggcaacaaaacaaaaggataagccacaagtaaataagaacaagaacaaccaaagccttggaaacacaccatcattcttaagttaaaggcttaaaaaaaaaatagaggaagactgctatgactgtggactttctattgcattcacataataaaatcatgcgacattgttttgaattcaaat

SEQ ID NO: 14401 - DNA, 401 bp, Homo sapiens
aaaactagacccagagagtcaactcaaatgattttttttactaataagtgaaccataccatatatctatagggatggattaatggtcacaagccttatttatcagatagcttatgtctgcaaatttaatttcctatgccaaagattctggaaataatgtgaacaaactgtaattgcctgtaacaaacacatttataagtaagttttaaaagtctttgtgttcacagtttagtagctcacagaccctgttgctgtttctcagaaaacatttaaaagaggaagtatacttaaatatccatgtgattttgaaaatgaaaatgattctataattacagacaggattagagtgttgcatgtgcccattacatctctccagcctccatgaagagtctcagtctgcac

SEQ ID NO: 14402 - DNA, 568 bp, Homo sapiens
gggctggtcactataacaattttctatctcgttgttgctgggttttctatagttcccatgcaatggacaccattcccaggaaggtagtggtttccaaactttagagagcaaaaatatcacctgatgggtaatatgaaaatgcaaattccagaaccctacctccagagagcctagggcaggcccaggaatcctcattttaaaaataggcatccttgattccagtgcagttggtctactcaccgctttctgagaaatacaacagtataattaatccagggcccctgctggtgagacaggtctagaaacaccctgttaaagaggcacagagtttcagtagttccatctggtgagcaaatctgacgcctgtgaaaggcaaattcatggcccaactgtgacaattaacttgttacaattgcttggaaatatctactccttttacttggttttgtcttgtctttgatttttaatgttgttgttttacctgtgtttaatactaaatatcagttcaaatcttgcttggaaacaggagggtagaaatttttattaaattttaaaaaaattgccaaaa

SEQ ID NO: 14403 - DNA, 447 bp, Homo sapiens
gggctggtcactataacaattttctatctcgttgttgctgggttttctatagttcccatgcaatggacaccattcccaggaaggtagtggtttccaaactttagagagcaaaaatatcacctgatgggtaatatgaaaatgcaaattccagaaccctacctccagagagcctagggcaggcccaggaatcctcattttaaaaataggcatccttgattccagtgcagttggtctactcaccgctttctgagaaatacaacagtataattaatccagggcccctgctggtgagacaggtctagaaacaccctgttaaagaggcacagagtttcagtagttccatctggtgagcaaatctgacgcctgtgaaaggcaaattcatggcccaactgtgacaattaacttgttacaattgcttggaatagctgtgtaggggtaccgagctcg

SEQ ID NO: 14404 - DNA, 427 bp, Homo sapiens
acagtactctttctccaaagctggccatgccccttctctatttgaacgtgtgagcttgtcctcgctaaaagaaccatcaaggtggaggaggtcaagggtctgagtgaaggtgatgggaggctgtcctggtgagaagcactaagataaacacacagccggccatccatgggtccaatcgtcacctccacagcagcagaaagtgccttcaggaaaactcagggcccacaggtatctgaggctgcagtgtggggaacaccacctctgtcccaggaggggcctttctccctccagaaccttctcagcactttcttacttcccacgcccctctggcaggaaggcaccatttgcccggtggctggcacaacacaaaactgttagacaaaaaggctaggggattaaatgtcaatgtttagataatcaatgtaaa

SEQ ID NO: 14405 - DNA, 152 bp, Homo sapiens
tatctcacaatcccagactataaagtgataatgaagtttatcatggtaatttaagtcacagagcactcccaactagcaaattcggctgggttcgttacttaattaatgatttttttttttttttttaagacagagtctcactgtgtcacctg

SEQ ID NO: 14406 - DNA, 967 bp, Homo sapiens
cgtctggctaatttttgtatttttagtagagacggggtttctccatgttggtcaggctggtctcaaactcccgacctcaggtgatccgcccgcctcggcctcccaaagtgctgaaattacaggtgtgagccactgcacccggccaaacttattgttttaatcccagcatttatgtttagaagaattaatttaaatatttcttactatttctctgtcgaatgtttactctcatcttatctcaatgaaagaagtattaaaagtcttatggccccaaaagaaacaagccaaactgtactgtcttaaaagtgattcattctgagcttgaaacgactctgtcagtgtttgacattgtcatttctagtggcatgtatcttaacattcttttcctgcttcaggaatgaaatcacttgtcctgctgagaaaataaggggaaaacaagatagaagtaaaaaacaacacacctgttgaactattttcataaagatggcgttttcactttcaaaagaaatgaaaaccagatggtctatgctaagaagtgaaggcattttgttgtcttcagaactgatcaacatggtcatgatcatcatcaaatttcttgtttccaaaggccactattgtagtacagtctccagcaggattttgtaccatgtgctgcctttggaataaagtattataatgtatcttgtcaccttcatcaacaccaccattaaatatgtaagttcctatatgtgactttttctgggcatatttgcatcaaaaatcacagtccttgcctccttgcttgcttttactccatgaaacgcttcatgaagcagagcatgattgtcaagtgaccagagggatggacatttgtaagtggaacgtgggtatacttcacacatggctattacttcatactacataacttagttttctcccaaatcaactggcagtccgttttatctatgatattcctggcttcgtataa

SEQ ID NO: 14407 - DNA, 122 bp, Homo sapiens
agatgtaattctaataagtagtagcagctgcttttaattaggacaggagatgtttaaggcagatttactgacagcatgaaacactgataaattattcatttatttgtttttgagacagggtc

SEQ ID NO: 14408 - DNA, 376 bp, Homo sapiens
atcttggctcactgcaacctccacctcctggcttcaagtgattctcctgcctcagcctcccaagtagctgggattacaggcatgtgccaccatgcctggctaatttttgttgttgttgttatgtgtaatctacatactgttttatggcaacaaatgtgaacatttaagccaaatttttaaagataataaaagtggaaaaaataaagtcaagataggattgactacttaaatatactaacaaccatggaataaaatgaaggggatgcacatatccctaaaaatgttaacaggcccagatggctttatgggtaagttctaccaaatttttattgaataaaaatgatactatataccctatgaactgtttcagacccga

SEQ ID NO: 14409 - DNA, 1553 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14410 - DNA, 2330 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggcaaaaaaaaaaaaccaacaaacaaaaaaaaaaaaaacaaaacaaaaaaaaaaaaaaaaaagaaccaaaaaaacgcagaaacaaaaaaacagcaacaaaccacaccagaaacaaaaaacacaacggggcgcgcgcccccccccgtacatcctcctccgcccgcgggcgcgccgccccctgcgccgccctgcgctaccgccccgagttgtttcttggtacgacacagcgcgagcacgcgccacactagacaggaagtgaggcagctctatattcattatactatacgaaagacgacgagccgcgaccgcgcctcgatattatagatatcaacaacgccgatggtgacgctgggtgtaagaaatggagacgcagacagcggcgcgcggacgacagactcgtctggtgctacatgcgaacgagacagctcattctagacagcaggggcggtgcaagcacaaccaacagtagaggtggtggcgagcgagccagcacgcgctacgacgcagtgatagtgtaatgatagtacgcgagccgcggggtgcgggagagcgggcaacacaggaacgtgtcggtttgtcgccgtgtcgagtgcgggcgagttagtgacagcttggagcgcgtggacggagcggttccggcgcacgtgggccggtatttcgggtcggcgacgggaacgcgatcgacagaggacgcgagaaatgcgtcgttgtcacgcgcggcggcgtggtgaggtgttgtggtggccgatcggagtgacagcggcgggtggagggcgtagg

SEQ ID NO: 14411 - DNA, 1432 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14412 - DNA, 1457 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacgtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14413 - DNA, 688 bp, Homo sapiens
ctcttcttctcaaacagccattcttccaaatctattttgggttcatttttctttgcataatccagggaatcataaatcatcccaaacccattgtcttgcccccacccaaatgagttctgaatcccaataccaagatgacatcccgtgtggtcttgtacatatttggctaatttttcccgaaattctgtcttaggcactgtcgccttcccggggtgaaggacatcaaagacccattgtttcctctgaagtatcggttggtcatgaactttctagtgcggatagttacggtgtcgttcatgatggcgatctatcttaaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggccaaaaaaaaacacaaaaaaagggcgcc

SEQ ID NO: 14414 - DNA, 179 bp, Homo sapiens
ctcagctggaccctccccgggctcgagggcagggactcgcgcccacggctcccccagctctcactcagcccgggaagcaggaagccccttctgtcactggtctgctggcctggaagactctgtggggtcagcactgtactccgttgctgtttttttataaacacactcttggaagtggc

SEQ ID NO: 14415 - DNA, 1704 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggcctggggagctgtggtcactcacagggcgggcaggtgaccagggcggtggaggcgacgctgtgtcttcccagctgccctgcctagaggcccagggtgcaggcaccgccacccacccgtgttccctatccaggagtggacccacatcacccta

SEQ ID NO: 14416 - DNA, 1596 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggcgcaaaaacacaacaacaacaaaacaaaaaaagagggcggcggc

SEQ ID NO: 14417 - DNA, 1506 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcaacccctgagagggggaaccgttcctgatgg

SEQ ID NO: 14418 - DNA, 1369 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccaaagcaatgtcgagccttgtcagcgctggacacaggggagtgggtcaggcaaccgaggatagctggaaaaggcgg

SEQ ID NO: 14419 - DNA, 1396 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14420 - DNA, 1267 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14421 - DNA, 1839 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggtaggccgggcctcgggggtggcttctggggtttgagtggggccggctgagctggggctgtgtggggctgggtcccggggacgaggacacagggctgcctgtgcctgggcgagctcggcctcagtacctccctcagggccagacacagaggctcggaggccacacgacccgtccaggtagccagggagaaggcagggtgccaggcaggcctgtgggtgctcagcagctgtcttccagcgcacgctgtctccccctctctctctgtctctgtctctctgtctcccaggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccggcttccaaataccactctgtccggctcccccagctctcactcagcccgggaagcaggaagccccttctgtcactggtctcagacacaggcccctggtgtcccctgcagggggctcagctggaccctccccgggctcgagggcagggactcgcgcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14422 - DNA, 1191 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccgatggcccaggagcagatgggaggaccccgaggccagacgcacactgtccgagccctctgctcagccgcctgggacccaccagggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggc

SEQ ID NO: 14423 - DNA, 917 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcctgctggcctggaagactctgtggggtcagcactgtactccgttgctgtttttttataaacacactcttggaagtggc

SEQ ID NO: 14424 - DNA, 1169 bp, Homo sapiens
cccgcccagccccgccgccctcgcaataaggggcctgagcgcgcgggggagaagcgggagcgggagcgggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgcgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaacctcaaagtgtggatctatcccgagggtactcgcaacgacaatggggacctgctgccttttaagaagggcgccttctacctggcagtccaggcacaggtgcccatcgtccccgtggtgtactcttccttctcctccttctacaacaccaagaagaagttcttcacttcaggaacagtcacagtgcaggtgctggaagccatccccaccaggtgcagctgggctccagggtccagcccacaagctgcatcagggtctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggcctggggagctgtggtcactcacagggcgggcaggtgaccagggcggtggaggcgacgctgtgtcttcccagctgccctgcctagaggcccagggtgcaggcaccgccacccacccgtgttccctatccaggagtggacccacatcacccta

SEQ ID NO: 14425 - DNA, 498 bp, Homo sapiens
ggatataaaattttattttttactttaaaaataaaactccaaatcctatctgtcttagagcatctactctaaggttcaaggaacatatcgagggaagtggtgatctatctaactgctatccaaatatagaatacatatgacttgtaccacctgcttcactggtactgggctgggtgacttaagggcatctagcagtgagttgttggtaaaaggggaaaagagtctgggttgttggtaaaaggggaaagtcaacctgtaggaacctcaatcccaagttcctcactaatttcctgaggggaagtcaaagcctcagtacaaacttccaagaatctaaactactgattacaaaccatttgcccaagtaaaagacttaactcttgcttcccaaggcgggggaactgatggtttcctacatcaccagggggagtaaaagactaatttttaaagcatgtatagtccctagtcagaagaagatcctctaaggctcatcccttctag

SEQ ID NO: 14426 - DNA, 406 bp, Homo sapiens
aacaaaataagtctccagaaaccaacttaatgaaatggagagattaaattacctgacgagaattcaaaataatcatcataaagatgttcaataaactcaggagaaaaatggatgaacaaagtgagaatttcaacaaagaaatagaaaatattaaaaatggaatcaaatagaaatctcagacctgaagaataaaataactgaagtgaaaaaatcactacctagttttaatagcaaacatgattaagctgaagaaagaatcagggaacttgaagacaggtcatttgaaattgcccagggagcaaaataaaataaaacaaaataaacagtgaagaaagtctaagggacttaggaaacaacatcaagtttgcaaatatttgtattatgggagtctcaaaaagagaagaaa

SEQ ID NO: 14427 - DNA, 371 bp, Homo sapiens
atagactaaaagtaaagtaaatgttttaaatttgtattacgtctaaagatttgtacgtggatgtcattaatttaaatgtccatactctatttataaatcttacttacaaattttgtaacatggaacaccatttgatttataatacttgcagaagttcctgtatgctgttaaataaattaatttgtaaaataattttgcattctatatttagttcagcatttaattgttaaatgagtttatagacttgatatgtgggtgaatgaaaaatatttacattaaaatcatccaaggcattttccatttatttttgtaggtatggcatattttaggaaaatgacttatggaatgtttccatcatcacagaaacagta

SEQ ID NO: 14428 - DNA, 399 bp, Homo sapiens
tgcttaaacaatccatagaccaaaactgttgagggaccactggtaagtggtagcctcttataggcaaagggatgcagtaaaggacttttgtaagttgttttttaaagtgtgaacatcattgctatgatctgaatgtgtcctccaaaattcatgttgaaacctcatcattattctaacaatgtgtcatcagaaaaaattttaatgaaattagcgttaaagtaaatttaatggctatggcatatttgaatttgtggacgtatgttttgcaaagactctgcttctgtctttattttttggaaactaggacatggactgtgggaggctgaagtgggatgatcgtttgagctcagaaagtcaagtctgcagtgagccgtgattgtgccactgcgttctagcctg

SEQ ID NO: 14429 - DNA, 601 bp, Homo sapiens
ccaaaagcttggattccagtgatctcccagtctttgttactcttccttttgttcttttccagatctgattcaggaatttttatcccatttgccttccttaataagccagcgtggatcgtatacacagacagtggattttagagctagggtttgtttgtttgtttgtttgtttgtttgtttttgttttgtcctccaaaatttcaggatatgtcagttctcatgtaaatatatacccccttttgtgagttagtttagtatctcctataacacctggtcaagtggataattttttagttcatgatagtttgttaattggacttgctcagccatattttcctccttattatacatggtcttcaagtctatcttggaaaattttagagaaaaggacaaatgctaaaagacttaatagtaccatgagaccttttttgctcccttgttctgtgctagctatggggataaatatagttgatccttgaacaacataggtttggattgtgtaggtccacttacatgtaggtttttcttcagtaaatatactggaaaagtttttggagatttgaaaaaactcacagatgaactgcatagcctagaaatactg

SEQ ID NO: 14430 - DNA, 561 bp, Homo sapiens
atgtttagtaacattttaatttctcttattcgactaatgttttaaaggtatgaccactttagaacattttcttattcaaccctcacagtattgctgtgagctaaaagagagtattatttttcttgcatgtttacagttgagaacattcaggcttagagtgttatgtgacttgctcaatcatatgtagcaagtaagtggccaatctggggccagatatctggtttctgcatcccaaaactgagttaataagaattttttcatgtgaatgattataatttatgatagttttatttctgctgaaatgtctagttataccatatttttattactgagcaatgttatagatgaataagatgcaatttgctagcttcattcagacagtttctcacttattttaaaaatgtgagtatctatctgttttgtgcatcaggaggaaaaaagaaaaagagatacaaaaactgccctcaaggagtttacagtctagaggggaagcaaataaataaatgtgttcactgcaataccataacaatttgtgtagtacaataaaaaatacatttggtc

SEQ ID NO: 14431 - DNA, 461 bp, Homo sapiens
gtttgtatctcagttgtgagtaacagctcttaaaagctaaaaatagggatcttcatgggaaatgaaaaagaaaatgtacaacatccatgcaattgaaggtaggctctcagtaaactaagaaatcttttcagaggtaaagaaaatgaaataatgatttgaaactaccacccaactctccatttcctatttgggaaaagctaaggttctttggaatatctaactttttcaaggcttatgacaccctcccctcccatccacctctcccctctctccagttcctagaaaaatgactgcataatgtgcttgtggaatttttgcaaatggctagagaaagctctggaaggaagaaaggacaagctacatgttcttcacgtgtctccatgcccctaatgcctcactccccattcaaagctaaggacctggccgggcgcggcagctcacacctgtaatcccagcacttt

SEQ ID NO: 14432 - DNA, 555 bp, Homo sapiens
catcctcaaacagccatgaggaatgggaagggaactttccctatgtttgcagaacgaatccatctctggatgagcgaacaactttcagcccctcggacactcaatgtcaagcttggtcctctccagtgtggccaccaggctcccacctgaaggcccagctctcctcaagtctctgaggctaatgctgagcaaaggcaggagggatttgctcacttgctgctaacctggcaggtaaagaaagtgaaccaagaaactgggcacctcagccaaggcctccgacttctcagccccttgtcctctgttggttcagttgaaactctgccaccccaaaggtgcctgagagcatgggctctgcgtgccacgtgcaggtccccaagacaactccacctctggaaaagaaaatgactctagagcttctctcccagggccctctccctcacgccaccacaatccccagtgtggacccctcctgccaaatacaagaggccaaagtaattgccctggcattacagttttccccccatggccccaaaccacctacctaaccatgcctcc

SEQ ID NO: 14433 - DNA, 515 bp, Homo sapiens
agcttacttaccttactttttgtggaggtgctagaactacttctgtcttgtgtttagatttcaagaaacctttgcatgggcattatgtggttgcacaaatgtacttcgttttgacctgaaaatgcaaaaacttcctttcttcccactttctgagactctgcaaccttaaaggaagagtggggttctttaaaggaaaggtggtggtggttgggtcatgggtaacaatgtctactgtgtacttcctttcccaaaacaagtccctgtctaccgtcagcatttccaaaatttgaaggtcaagtgtggtgttaactcatgaactaatgactagactttgagcggttgtggaagcaaaatctcagtgagtgcctggatgttctaattctgttaagtcagtgagtgcatattctgtacaatactctcttagcccagtggcaggtttaaggagtgggagagagatttctatgtttcggaaatcagatacacaaagaataaaaatttttaatcccaaaaatctt

SEQ ID NO: 14434 - DNA, 679 bp, Homo sapiens
agaactgcccctaggagcagctccttgattcccagtcccctgctctttctaccctgcataatatatgttgtaagctttttgtttctttatagttgtttgcctagtgttcattttagttactcgaattccttgcaaggtaggttttgtttgtttatttatggaagttatttagtaggaatttcacacttaactgggttttcctttggcgtatgacaaccttacctaggacttagaaatctgtgatttctgagtttttggaatttaggaaaatgctctgggtaggattgatagtagattgaataaattaagactttaagacagaattgtagacttttggagttgggagataatttaaagaatattttaaaccaccagttttacagatgaggaaacatgctaaattaatcaccacatttacatcttattagtccttattaaagaatggtaaccaaaagtctgtttgaaatgtttgctctatttgtttggtttcattacatgacagagctgcaggttcttgatattaatgagtaagtggaatgcagtttatttagcagtgttctattagaggtactgaaattttcagggataaggaaatgaaagagagtttagcattgggaaatttgcaccatggatagattaagaggtagacagttaatagaacatttacgggttggagtag

SEQ ID NO: 14435 - DNA, 413 bp, Homo sapiens
gagagggcctggactcctacaggagaaacgcctgaactgatagagggagttgcagccttctggtgaatgggagttaaggcaagaatcatcaacggatgctgaaatctagagggggaaatttgaggaggagcaggattttcgcatagtctcaaaatatctctctattgattgcttattagctgcaaggggaaacaaagtaagcactaattggagtatccagatcacatcatgactaggtgatcaaaattacatcactggtgagggacagatggacgtcatgtgcttcctgaggtgataccctgagaagaacacaacatcagttatgctatatgccagtcagggatggaaaacctgaaactaatcataaggaatctcagacaaacccaaattgtggaacattctattaaaaaaaa

SEQ ID NO: 14436 - DNA, 490 bp, Homo sapiens
tcacaatagggtttgtgctcccatgagaatctaatgctgctgctgatctgactggaggcagagctcaggtgataatgttcactcactcgctgctcacttcctgctatgcagcctggtttcctaacaggccatgaactgcccaggggttgggggcccattttaagccactgggtttgtggtaatctgttacagcagcaatagaaagttgatacaaacagtaatgtgtgagagtactttatggcctttttcacagtgtattgaacttggatttttgtcagtgagatagatgagaaattgtatttcaattcgtgttaatttatatttcttttcatctttaaaaaaattgatagttggtccttcttaatttttggacctctttatagactagggatattatttctctaacataaattgcaaatattttccccaatgttttgtcattcagaaaaattttaataaagtcacgtttgtcgttcttgttgctcttgga

SEQ ID NO: 14437 - DNA, 424 bp, Homo sapiens
gcataagctacttatcttttaaatatgataaccatactaagcttttctaaaagcctatcactccaaggagcctcaaaaattctgtgttgcagatggggttatgggggaagaagcatggatacaactcactttacttaaacttatggaattggacttatatgttggtatcagcgttttataataatttcccttattcagccatgtatcctgcagaaatatataataatcatttctatacattaatccaaatactatagcccacaaaccattttccagaactaagctattaaaaaaaaaaaacaaaaaaaaaacaccttcatctccttatgaaatgaagcaaccaacattggtacctagttgccactaggccattttatgacctctgacaccaaatgttgaaaggcacaaggtctaactaaaatat

SEQ ID NO: 14438 - DNA, 473 bp, Homo sapiens
cctcccagcttcaagcaatgctcccaccttggcctcccaaagcgctgggattacaggcatgagccaccatgcctggccattgccattgcacttcagctggttctcctgaaccttgaattatcttaggaaagattgtattttcaggaattaagtctattggagacacagcaggactccacagccagctagatttggataaaatgtagactgcctcaaggccagtgtgttgacttctgaccagtctcatctgaacccacaccctttaacatatatacaaaacacctgaagggttgggctgccagctttctttaggatgatagagggcaggttaagtttgtttgacataactagaagaggtggagcctcttcctaatggagcaaggtccatttatggcaaactgtggtcccccaccactatcagctacttctggatagcttttgcttaaagttgatgagatattgtttctttcaaa

SEQ ID NO: 14439 - DNA, 1045 bp, Homo sapiens
  misc_feature (113)..(113): n is a, c, g, or t
ctgactacggatgagggaatttagcctggaataaggaacttttatttccagcttagtgacgcacacaaattttaaaaataaaataaaaatcatgttttatgtgattcatgttnctcctaatgcaaagaagacgggtactattactaaaaatatttttaaaatgtaagggctaaggccccagaagttctgctatgattttttatgtttcatagagtgattatcatcacagaagctcaagcattacataaatacaaatgcgtgtaccccgacctggtaattctgcttcttgaaatttatcttcaggtccacccgcacatctacaaattgatgtatattcaatgttatgtactgcagcactgtttataagagcaaaagactggaaacagcctaaatttccatctataaaagactaaataaataaaggtacatccctaaaatggaatattatgtggcgttaaaaaagagagagagagaaagagaggagaagcaagaaaaagagaaagctttctacattcaaactaatagtagaaaactctccaagatacaattttaaggaaaaaaaaaatcaaagtcgagaagacaatagaggaggctgcctttagtgtaagacagttgaaaattataaatatattcatatgtttataaagaaattttaggaggctataaaaaaacaaaacaaagggaaagaggaacaggagctgggacataggtgagcaagatgcatggcaggcatatgtcttcatcttcctatgcttttatttaaaaatgttggaccacgtgtacatgttatctattttaaaaattagattttaaaatacaagcaagaaaacaagaaaatgaaagcataaaaagagcatgtggaactaccagtaaaagatactaatccatggagataatggcaaggtagctcctagatgcactgatttctctaccacattgtataaacaagccatcaactatgggatttgtaattaaaaatgagtctatttgaaacaccacactataaaaagctattaagtaaatctttaaagtgacagtaaatgat

SEQ ID NO: 14440 - DNA, 403 bp, Homo sapiens
ccaggagcttaaatataattttaaaagttatctctgaaattattggaaacacctttatagggaatattgtgaaataacattgtaaagaataatatgctgtatttcagttttgaaataaataaaaattttgaaaaatacaatgtacaaatgcatatccatggctaaaataattcaagtccattagttatttagaactatataaacaactacataaaacaaatttacagttacggtacctatgtaacacaccaaatagttaaaaagtacataacctattctgcaaaaagtgacatttgtagtttgatcagaataggtttgaatctgtaaattgctttgggcagtgtggtcattttaacaatattgattcaatccatgaacatggaatatttttccatttatttgc

SEQ ID NO: 14441 - DNA, 375 bp, Homo sapiens
tctcgatcttctgacctcgtgatccacccacctctgcctcccaaagtgctgggattacaggcgtgagccaacacgcccagtcaatttttgtatttttagtatgggaggggtttcaccatgctggccaggctggtcttgagctcctgacctctagtgatccacccacctcggcctcccaaagtgctgggattacaggcgtgagccactgcacccagtgaaaattaaatattttaaaaatatgaccaattaatactttctttaatgcgaggcaattcaaggataaagtgagatcttacagagatttgcaaatcttaatagattaatgtctacttctttccaatgaccttcaaaaattcaggttcaaagagaattatc

SEQ ID NO: 14442 - DNA, 447 bp, Homo sapiens
gcagtgacattggacccacaccattgctttcagaatcctcattctgggaatttgccaactgctttctcccagtgttctgtaggacattgtttagctttggcattcctagtcaccctaaaaataagaggaaaacaatcatcgtagttggaccacttatcttacaggtatataaggaagacactggggtcatttacagagcatggggagaaagctgttggcatggtacagtggttattgggtgcccactgtgaacagacattgtaggaactgtcttcaagagaagcccttgagggataggcttctagaagttcaggtacatgctggatttatctatgcaaattataatgtttccccgcttccctccctccctccctccctccttctcttctttagaagagaatcctcagattctcaaaaagtatcaagcagagtcctatggatggtaac

SEQ ID NO: 14443 - DNA, 487 bp, Homo sapiens
cgtctttagatttttttttagtccccagtagaaaaatactctctgtatgaagaacattcaaaagtgtgctcaaaaatgaaacccatgctcttactatgaaagaacgttagtacccaggttttccatgagattctctacacaggcaagaagctccatagaagtggcatttgaagggtgtggcagaggcagtgctgtgtttatcacactggttccatttccttgcaaataagaagtctatttcccagtaacccttgcagttaagagtgtgcccatgtgattgagttctagccaatggagtgtgagcaaaagtgatataagccactttcaggtctagcctttacaaacatcctcaggcttctctatccctgccaaggtgaccttggaggctgcttattccagactgggttgatagaaggtcactacttcatctgtgttggatttctttttagagtaagaaataaaagttcattgtgtctcaccactgaaa

SEQ ID NO: 14444 - DNA, 919 bp, Homo sapiens
tgagacagggtctcactttgttgcccaggctggaagtgcagtggctcaaacatggttcgctgcagcctcaacctcccaggctcaagcggtcctgctgcctcatcctccaaagtagctgggaccacagacatgcaccaccatgaccccagctgatttttgcagagatgggttttgccatgttgcccaggctggccttgaactcctgggctcaagtgatcctctcaccttggcctaccaaagtgctggcgttacaggtgtgagccaccacacccggcccgagtgagccattcttatctcttagggaatggtgggaaccctcctggagtctatgttcttagacaccacccaagggccaaccttgaagcaggcctttccaaggatcgcagttgaggcctgctctgttactgtttttctgcacagtgtgcaacaccacacagatgcccagtttctaccaaggtctgtggatggcaggataattttgaggaacctcctttttcgctaacactttcttcttttgtttacactcttcacattgtctattgagtctggattcaagatgattgattgtgaatattgttgtgcatgattttgggggtttcctccttgtgaaattttgaggtggcagatttgacattctactttaaactcatcttggtggcacttttcttgactcaccacctaagggggaataaataatgaagaaagaataaaaatagtgttatcagtcaccaaaaaacaaaaaaaagggggggtttaaatatccctggggccaagttagggtcccggttttgtcaagggcctaagggtgataaaagaagcaggcgggttaagtgatggaaagggtggttgggaagattttggggtaaatggcatccaggtagcaggataatggtgtggagtttgctaagtgttaaaagca

SEQ ID NO: 14445 - DNA, 697 bp, Homo sapiens
tcatcgtcatagctgattccagaggataaaatgacgttcatgggcacctagtcctgagcaagccattcttatctcttagggaatggtgggaaccctcctggagtctatgttcttagacaccacccaagggccaaccttgaagcaggcctttccaaggatcgcagttgaggcctgctctgttactgtttttctgcacagtgtgcaacaccacacagatgcccagtttctaccaaggtctgtggatggcaggataattttgaggaacctcctttttcgctaacactttcttcttttgtttacactcttcacattgtctattgagtctggattcaagatgattgattgtgaatattgttgtgcatgattttgggggtttcctccttgtgaaattttgaggtggcagatttgacattctactttaaactcatcttggtggcacttttcttgactcaccacctaagggggaataaataatgaagaaagaataaaaatagtgttatcagtcaccaaaaaacaaaaaaaagggggggtttaaatatccctggggccaagttagggtcccggttttgtcaagggcctaagggtgataaaagaagcaggcgggttaagtgatggaaagggtggttgggaagattttggggtaaatggcatccaggtagcaggataatggtgtggagtttgctaagtgttaaaagca

SEQ ID NO: 14446 - DNA, 1393 bp, Homo sapiens
  misc_feature (1393)..(1393): n is a, c, g, or t
gcgccccccgggccgaggcagccgggccgaggagtgtcggtgtggtccggctacggggcggggccggcggcggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccctgccggagcgagggggcgggcgtgggcggacgtcggggcagcggggaccccgcgcggctgcaagaggagggggcttccccaaggatgcccggcggctccccgctcctaggtgcgagctgagtctgaccgggagcgagcggcgcgtcgccatgccggcgtgacgggcgcccccggctgcccgcgcgggcccccgcgctggcccccacgccgcgccgtgccggcaccgggctgcaggatgggctgtatccaaagcatcacctgcaaggcgcggatccggcgcgagaacatcgtggtgtacgatgtgtgcgccaccatcgaccagtgccccacgcgcatcgaggagacctcgcccatcgtcctgcgctacaagaccccctacttcaaagcctccgcccgcgtggtcatgccccccatcccccgccacgagacctgggtggtgggctggattcaggcgtgcaatcagatggagttcttcaacacctacagcgacctgggcatgtcaagctgggaactgcctgacttgagggaagggagagtaaaagccatcagtgactcagatggggtgagctacccttggtacgggaacaccacagaaactgtgaccctggttggccccaccaacaagatctccaggttctccgtcagcatgaatgacaacttctaccccagtgtgacatgggcagtgcctgtgagtgacagcaatgtgccactgctcacaagaatcaagagagaccaaagtttcacgacctggctggtggccatgaacaccaccacaaaggagaagatcattctgcagaccatcaagtggaggatgagggtggacattgaagtggaccctcttcagctcttggggcagcgggcccggctggtgggcaggactcagcaggagcagccccggatcctgagccggatggaacccatcccccctaatgcactagtgaaacccaatgccaatgatgccaggtcctcatgtggaggcccaagcgggggccacctctggttgtgatccctcctaagtagaagcagactggcctgactgtgtgtggatcacacgcctctgagacatgcagtgagggtgccaggggtggn

SEQ ID NO: 14447 - DNA, 494 bp, Homo sapiens
gagcacgtcctgtgctgctccagccgttggggctctccaccccgggccacagcctcctggcgccccccgggccgaggcagccgggccgaggagtgtcggtgtggtccggctacggggcggggccggcgggagctccggtcgccgccgccgccgctgctgcctccgcctgcctcttgggccgcccgctcgcccgccgctgggtgcgctgcacgcggggggcagccgtggtgcagaggttcatgcagcggcggcggcggcggcggctgctgctgctgccgccgcggaggcagacagaccgggcgctgccaccgccgccctcccccggctccatgccgccgccgctgccgcctcctcctctccggcgaggggcggggggctccggcccggggtgggcaccattcctcgcagcgccgctcccctccctgccctccgcccgggcgctggagccggcgagggcacccgccgcctcctaggagtgcaccctccgcgcgccc

SEQ ID NO: 14448 - DNA, 433 bp, Homo sapiens
cagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcact

SEQ ID NO: 14449 - DNA, 360 bp, Homo sapiens
ttttttgtagagacagagtgtatgttgcccaggctggtctccataattgtctcccgtcttagcccccaaagtgctggaattacaggtgcgagtcaccgtgctcggcctgaaggttatacaactattaaatgtcaaggcaaagattcagtccagctctgtcagaggataaagagtatattcttcttcagttataatgctgataagtctgcttacggttctccgacttgtacatccacatctctatatcttttcttattcactaaaaggcttctaatccgtctaatctttttgttagttttaagcaggctttaaagcgactttttttttttttacacgttatcattgatttgtattttattt

SEQ ID NO: 14450 - DNA, 450 bp, Homo sapiens
cccataagtatgaagttttgagttatagtgagagattattatcttttttgtgtgcttatgactaaatataggaaaagtacctttagaagtttttcaaatagcatgagcaactatgatgtttcaaagtattaattatgtaggagttgtgaatggggagagtcatttagttgcttggtcataatacttataaatggggataactatttagcctatttctagttcaaatgggtctctgaccatattgatcattataaggagccataatctatatagagagattgtagagtatgaactctgaagtcagactgcctggggtgaacaccaacccagctgcttggtacctgggttgcttttgacaggtcacttatcctctcttgtctgtttcctcacccatgtaataaggataataataccctacagggttgtggtaaggattgaatgaaataacat

SEQ ID NO: 14451 - DNA, 2600 bp, Homo sapiens
atatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatcccaaaacagacaggtcttacgttaaccttcaccttaaaaaggatattgccttttttccttctgcttcacaaatttgctccaacactaattcccttgcatttgatttcatcattatgattgttcatcaaccattcttcacgaaaaatcctcacatcatgtcatataaaggttttattatttttaatggaaaataacattgagagattattttcctttttcataaaatttccctttttccctccctctattctctttactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagccttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaatcctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagttttaaaaattatcaatatgagttggtgcctaattttttctttcctaaaaataaaattttttctttttgtgagt

SEQ ID NO: 14452 - DNA, 2545 bp, Homo sapiens
atatgtaggctcatttgtgggagattgcaaactttatgtgcccccagttctccttggttttgtaggaaagctaaaagaaaaccttgtactctcactaataatgaaattcatagccaatttagaaagggaaaataacctgaaaaccaaaatacctcattcatctgaagatgcctggaataaaatatggaattcttctgtacctacctcccccttacagacttttctcctattttgagagagaaattcaagaagaagaatacagcttgttctctttccacaaatgatactttgtctaagggaataggagataccaagaaacagtatctttaaaaaagtaagctgcccacaggccttcttggagaatgaagaatatcagccccattcagggtttaccaatgtctctctgaggtgacaatacattctggttttccaggacagtcctggcttaggtctgctgtccttctataaatattaacaatgatccctcttatttccaaacgtgtcccagtttagacaacaaattatacagtgtctgcccccaacacacacacacacaccccaccatctttatgggttgttgttgttttcttgttgtttttaattttgtagaattggctttgtcttctccaaagcagataacagcttaaactaaagagcctagctacttctttctgactgagcagggtcatagtaaacagagaagaatggatcacttcctcctctgaaatctccatcaatccactttctgtccaactatctctctacccagcctatttttggtcctagttttcctctcataacccctgggctgtgagtcctgagttctgccttcatatggcagagcaagctagtcattattatgccaggttaggtggtggggcaagacaaaagatagctcttggggacacttgcttggtctgtagagatccacagggcactagtagggtattagagcatttattggtttctttcttccttgagttgagttacttctatccccttctgcttcacaaatttgctccaacactaattcccttgcatttgatttcatcattatgattgttcatcaaccattcttcacgaaaaatcctcacatcatgtcatataaaggttttattatttttaatggaaaataacattgagagattattttcctttttcataaaatttccctttttccctccctctattctctttactaacattggaaattaaacaagttttacaggctctattgttattaaccctcaaatctattcttcagagaatatatgatcagcctgtgtttactatgcacctactcttataccagaaactgtgaatacaaatacatatatttcctacttctctctttaattggggcacacagtcccatggtccattctgcatttttcaaaattgaatataattgcaacacctgataggttttgccacttagaattctgaaaataaatcaactctgttctaaaccttaagtttccactattattgccaaactctggactgatacaataagccttttaaaaggtgaatttaacacttcacctattatggttatttaagtaaaatgagttttcaaatatttcccccaggagaaatataaaggactatgcaaaaatagaaggagaaaaaggttagttagaggtccagaaggagaattaaaacatggaattgataaattcacctactgatttatgatgttaatgagcaggtacctatacattttatttacttgaaaacattttggccattaactatttctgttttctaaatacatttgtgtttataaaattttaaaatctatatcacaagccttagacatgcctttctttgcaataaagtatatatacctttttacaaatgtaaattttattttgaaacttggcattttctttataattcctaagatatctttgggcacacagactacagataaatctatttaaatcaattcatcattatcactggtttaaatatttaatgtaaccattggaatttttattcttattccttcagagaatcctccttttcttctatgtttctgactgcaatacagcccgatattgttattccctatatcttaatgaaaagcaagctgtcagcaaaatgcatttatagtttccagatgtttaacaatctctttcttcttttcttttttgttattatttttatttatgtgaagttagttagctgaggtaccaaaaaagagacaaagacagtattaaaaagtgtgcataaagcacttatttttgtactttagtacaatgttttatagaactttgtgatctatctaaatatattaagtaaaattacaccattcacttgttgggaaaataatctttggtttggaagatattaacataatgggcatcttagaatcataaatcacatgaaatgagagacaatgcaatattgtataattcctggatgatgcaattgttttaattgaattttcaagtgccattataaagttttaaaaattatcaatatgagttggtgcctaattttttctttcctaaaaataaaattttttctttttgtgagt

SEQ ID NO: 14453 - DNA, 480 bp, Homo sapiens
tgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattaaacgtgcgta

SEQ ID NO: 14454 - DNA, 408 bp, Homo sapiens
gcctgtgaagggtgggaggagggctgtggagctggggattctgggaagggaatgtcggcccagctgggaggttgtaccagatgacctcagctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattaaacgtgcgta

SEQ ID NO: 14455 - DNA, 495 bp, Homo sapiens
  misc_feature (47)..(47): n is a, c, g, or t
cgtggtagggaagggcgaccgcgaaactgggactttctcggagcccngggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagcagatggctgaggacaaggcctctgtgaaagcccaggtgacgtccttgctcggggagctgcaggagagccagagtcgctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattaaacgtgcgta

SEQ ID NO: 14456 - DNA, 1473 bp, Homo sapiens
  misc_feature (47)..(47): n is a, c, g, or t
cgtggtagggaagggcgaccgcgaaactgggactttctcggagcccngggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcacggctctgcgggaggtggagcacctgaagagatgccagcagcagatggctgaggacaaggcctctgtgaaagcccaggtgacgtccttgctcggggagctgcaggagagccagagtcgcttggaggctgccactaacggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattaaacgtgcgta

SEQ ID NO: 14457 - DNA, 849 bp, Homo sapiens
  misc_feature (47)..(47): n is a, c, g, or t
cgtggtagggaagggcgaccgcgaaactgggactttctcggagcccngggccctaccagcgttcacagtccgccgctcccacccttctcacgtctgacggactctgctgacagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcacggctctgcgggaggtggagcacctgaagagatgccagcaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacaga

SEQ ID NO: 14458 - DNA, 382 bp, Homo sapiens
  misc_feature (337)..(337): n is a, c, g, or t
ggctcatcaatactcgggcattattcttctatgctagatggcttttctataatatataatttcacaaatcaaaacacctacaaagttgtaagatttatgcccattagggaggttgagatggagactaaacatgatttgaaagtaggaacagagagaatggagagaagatttaaacatgattatcagtatcctcctctgagacccatttaaattacatacaggaatacagtacacacaaacacacctctaaaagaaaagggaggccaggggcggtggctcatgcctgtaatcccagcactttgggagactgaagccaggagtttgagaccagcctggnaacgcagagaccttgcctatacaaaacaacaacaacaacaacaaa

SEQ ID NO: 14459 - DNA, 456 bp, Homo sapiens
actagaattcgatgcccagagaaaatatcctttaaggatgaggagaaaaacatttacagacaaaggaacactgagaaatcttaccataagccaaccctttgtaaaagaaagtttaaataatatacttgcaatagaagcaaagtgatcagaatgaggaacaaataaagtgcataaaaaacaatagtaatatcttattacattttaacacataattaataaagcctataaatcaagaaagggatagagttaagagttctaggtcctactttcagaactagggtaaagtactgatgaacttaagacttggtaaattaagtatccctgttataattcctaggttaatgattataactacacaagcagaatgtataacttccaaattagtagaaaaaaatctaaaatggttaacaaaagctaattgaaatgaaggcaagaaaaaagtgaaaagaaacaaaa

SEQ ID NO: 14460 - DNA, 403 bp, Homo sapiens
atcctatcagtggaggtggattaatatagtcccctcacaattctaatgactgcaggcttgcttgtgatgttgttggtgtagggtttaggtaagagtggggctcagggttgtccttggggatacaggaccagggaaaggagacagatacagccctcaacaacttatgcagctgaaaccaaactgaaatgaatataaggggcaaatagtagaaaaaaatcattaaaattcaacttgaggagtgtgtaggagagagatgttttgttctgctttgcctaagtcatggtagttgtgcaaaaagtgttggtcttaaaactcaggcttcttttggtacaaggtggttctgtgtcccccagctgctcccctttaccctctcccatcccgttacctctttattcacaagaga

SEQ ID NO: 14461 - DNA, 517 bp, Homo sapiens
gatgtagcacttacatgagatgaaattatgtgagatgcagaattcagattgcagtgaccattcataagttttagtgcagcatagctatacacattcattcatctatggactgtcattggtgactttggtattgtgatggccattgtgcaaaagagaccttatagcccacaaagttgaagatatttactgtctgaccttttccagaaaatatttgctgacccttggattacacctatagttttttccccaacctgttacacttcaccacacaggttaaaatagattatatatatataatctttgttttattttttgtaatagtacaaatttttaattgtactttaaaaaaattgtacaatttagtggctgagtgcagtggctcacagctataatcccagcactatgggaggcctaggtgggaggatcacttgagaccagagggtggaggcttcagtgagccatgatcacaccactgcactccagtctgggtgacaaagcgagaccctatctggggaaa

SEQ ID NO: 14462 - DNA, 312 bp, Homo sapiens
taaatataatttatataaatttacctattttggtttagttttactaaaaggggaccatgttgctataaaactaatacatttcagaggtacctgtaagaaaaatgtttaaactctgatttgcttcaaactatagtagaatatgtgtatgtttgttatcaggtgaatgggtagaatgtatttttattgtgaacatttttcttaattaatgaatatatttatttaagtgctaatgtttttttaaaggcaatagtaggcaagattcacagtgtatttcaagtgagagtctcttttcttaaatattttaatatcatt

SEQ ID NO: 14463 - DNA, 413 bp, Homo sapiens
tgtatttttagtagagatggggtttcaccgtgttagccagggtggaatttttttgtatttttagtagagatggggttttgctatgttgcccaggctggtctcttaactcctgagctcaggcagtctgcctgcctgggcctcccaaaatgctaggattacaggcgtgaccaccgtacccagccgctccagccttttttatttgcctttttccttctagcaaaaatgttccaattacaaataccctctgtctttccagactgccctaacgtccagtgcaccttagaatgctcatttccctcactcctccgttctttgtcttcaattgtgtaactcctatgtagcattttgactcagctcaggtgctggtcaccccggccctggcccatttcagcctcttggacctaaatctggga

SEQ ID NO: 14464 - DNA, 288 bp, Homo sapiens
gacccttgtttctctgccttttgggcaaagtgggcacattgcaatttcttcatctaaccaaggaatttcaaagcaaactgctgcatttcttttcatctcagagggttctggggctctctcctgagctgctgtatacttagctgacctcaagctgccagcacagagcctgggctctgttctgtggaaaaatagttgtgtgactttgagagaacatcttacactgttctctcaaagcacttacactcagtgttaatctgactcactgatcacaggacaggggattctcat

SEQ ID NO: 14465 - DNA, 1082 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14466 - DNA, 871 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtgcggcccggggccggcaggggaacccaggggaggagctctgagctccatgcgacacttccttttctgtggctgcaggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctaggtgaggggccggctcggggtgggcctgcttgggggacctgggccaggtgcaaagtctgaatccaggtcccgc

SEQ ID NO: 14467 - DNA, 777 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaagggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctgtgagtgctatggggccccagg

SEQ ID NO: 14468 - DNA, 3508 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14469 - DNA, 2816 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14470 - DNA, 3598 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14471 - DNA, 2075 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14472 - DNA, 3579 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccagggtaagctgcggcaggtggccaggacaggtaggatgactgggctagcaggttctgagcctcttctcccccagggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14473 - DNA, 3536 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggcgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14474 - DNA, 3872 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaatggacgtctgtgtccggcacttcctgcaggccacaggtcagtgagcagcacgggtgcgggtttaggtggtctgtgagtggtgggtccccaaggggctggaccgggtgcccggactgtagcccaagctctgcccacaggagctcctgggcattgggtacttggtgactcaggcccaggtgacaggcagaccagcagggtccttgttagcctgctgcagagtccctgagacagggagtgctggtgtggttgggggctgttggcaaagccatgtgggcttggggactgtcacctagctgtgtcccccaagcaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14475 - DNA, 3453 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaagggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14476 - DNA, 3439 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14477 - DNA, 3371 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcaggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14478 - DNA, 3158 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcaggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14479 - DNA, 3460 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggtgagcgccctgacccactgggtcccaggtcccagcccgcatgccaggtggcccacgacccccccagagcctgccctctctgctctcaaggcaccaagacgctgagtggcagcatagccccaaacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14480 - DNA, 2583 bp, Homo sapiens
  misc_feature (1)..(1): n is a, c, g, or t
  misc_feature (3)..(4): n is a, c, g, or t
nannatcgcgaaattcggcacgaggccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14481 - DNA, 3226 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggctgcagcatggagtcggccctggaggctgcatccctgcaccccgcccagttgctggggctggagaagagtaaggggaccctggactttggtgctgacgcagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14482 - DNA, 2573 bp, Homo sapiens
cagggagggtgggtcctccctagctccctcctctcaggtgggctgccggctgccagcctcagttgtagccccgtgttgccatcaggccgggctttctggtgttgcagacaaggccaggcaaggggttgcagggagcattgtccagtacctctgtccatctgtgatgggtcagggtgtcttgcactagtcgtgtccctgggcctcagtttccccaccagcgtcgggttgttggggagcagctctggggtaggtgggcggccccactcctgccccctactcattgcccggctctgtcccagacttcgtggtgctcgacgactcccttcacgtccaggccacctacatctcgggtgagctggtgtggcaggcggacgcagctaggcagtgacaaggacctcggctgagaggacacctggccgcagcgggatgccatcagggccgggtggttggggagctggtctccagggagtgagtcgggagccctgctggattgatgcccagggcctgtgcggccgccctggaggcggtggctgggataaacgtgcacccagcaggactcgccttggctccgggttttgcttgtgctcacatgtggcaccatccttggttgccctcctggagaaggcattcacggcctggggtgggatggctgggctgtagtttagcctgggccttgggccccagtgggggacagggcctgtctgcatgaagtggaccggagacctgcagaccccaggaaagtgtcactatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14483 - DNA, 1883 bp, Homo sapiens
cgccgcccccacccacccacctacggctaggtacgaggctcggtgttaaattcggcctatgggagggaggggcaggcagtcagtggctggtgccatggggtgaagccaccatgggctgggggtgaagagccggcaggaaggggaccagtcacagggagtgtggacagtcaggggtttgctttctgctcctgagttggggtgtgcagcgtggagcccacagcctggttctgggccagggcacagtgccaggggctccgctctgacctccaggagggagactgggcccgggacccctgttttctgctccctggactgcctagccctgagtgccacggatgaccagcgttctgttttctcttctcaataaccctatctcttcacacatccccaggcccagtgcttgccggctgtggtgaccctgcctggtgctggagggcagtatgggaggcaccagtgtgccctgctcaccccattagtgtcatcctgccatcttctgtgtccccttggccctggcacacacccatgtggcaaacacgggccgtgaggctccctgaacagcttcgaggcgggtgggcttctggagccctcttggctctgaggacagccacagtggggtcagacgtcagggattggtgcagccccacgtcaggggtgattgtcttgactttctctccatttgagttctggggtgggtggctcccttcccccttgcttacaggtgctgtcctgggcacaggaggtacgcgcctggctctgcactgttctcttccctctgctgcaaagcccagttaaggaaatgtctccaggtccaaagagataggatggtctggggccccacctgtttggaagggaacagccagggaagaaccacctgcctgggcagggcctcgcctgagggagggcctggggcagggcacaaggggttgatctcagcccacaagccccaggggcagcccaggaaagcaggcgacggatgtggatcctgacctcctgagaggtgtgaggtgcagggatacccacctctgccttgacggccgcgcaccccttaggaagtggctgtccagcgcctgcctgtgctgggcctgggagaggagctgtcttgccagggctcccaggcagggagaggcaggtgaggttctcagccgatgtgttagaggttgagcatcgcctgtgcccagcttgctggctgtcagtgcttgatgtgcccatcctcagctaaaacccagagctggcatgttggtcatccccacctcagacgggacgcccagtccagagctggtgagccctgggccagcctttgggcctggcctgccccattcaccggccagcgccccacctccctggctggagggtcggggaggggctggcagagatggttggtccacagggctagccctgggtggtgggagaggggcccagggtcagggtgagagagagctgggccagggagctgctgcaggatgattttgaggtgtgggggaagcactcttggttggttttggtttgctttttaaaaattgtggtaaaatacataacaaaagtaactatcgtaacctgagcagttctgtgacatgaagtgaattcactgctttgtgtgaccttggccaccatcattccccaccactcactcccgctgggctcccagccctgccccaccattccgctccctctacagctatgggttttacaaagaaggatgcagggcgccctgactgcggggtgaggggcaggcctgcccgcggtgtgggcattcgctgaagggggacgcccaggtgtctgcctgagttacgggttggggggtcgggcatgtggggagggatggagttggaggtgcatgctctcagagctggtaggggtggcccgtttcgtcccgtgtgtgaact

SEQ ID NO: 14484 - DNA, 1338 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccaccaccgcgacccaggcatcgtggggctcctgaccagcgaccggctgcccgcaggccgctgcatcttctatgggatgattgcagatggcacgcacaccaaccccgccgccctgcggatcgcccaccgtgcccatccccaggggctggtgctggtcaccgatgccatccctgccttgggcctgggcaacggccggcacacgctgggacagcaggaagtggaagtggacggtctgacggcctacgtggcaggcaccaagacgctgagtggcagcatagccccaatggacgtctgtgtccggcacttcctgcaggccacaggctgcagcatggagtcggccctggaggctgcatccctgcaccccgcccagttgctggggctggagaagagtaaggggaccctggactttggtgctgacgcagcacctggagggccccgttcatcaggccgggcagaagcggaggcgccgcagcccgaggcccaagctccgggctccttcgagggccgaattgccttccaggggact

SEQ ID NO: 14485 - DNA, 851 bp, Homo sapiens
ggcgcggctccgctctcggctggggttcgtcactgggcgcgggatttggccgccgcggggctccggagccgctcgctcccgacacggctcacgatgcgcggcgagcagggcgcggcgggggcccgcgtgctccagttcactaactgccggatcctgcgcggagggaaactgctcagggaggatctgtgggtgcgcggaggccgcatcttggacccagagaagctgttctttgaggagcggcgcgtggccgacgagcggcgggactgcgggggccgcatcttggctcccggattcatcgacgtgcagatcaacggtggatttggtgttgacttctctcaagccacggaggacgtgggttcgggggttgccctcgtggcccggaggatcctgtcgcacggcgtcacctccttctgccccaccctggtcacttccccaccggaggtttatcacaaggttgttcctcagatccctgtgaagagtggtggtccccatggggcaggggtcctcgggctgcacctggagggccccttcatcagccgggagaagcggggcgcgcaccccgaggcccacctccgctccttcgaggccgatgccttccaggacttgctggccacctacgggcccctggacaatgtccgcatcgtgacgctggccccagagttgggccgtagccacgaagtgatccgggcgctgacggcccgtggcatctgcgtgtccctagggcactcagtggctgacctgcgggcggcagaggatgctgtgtggagcggagccaccttcatcacccacctcttcaacgccatgctgcctttccacctagaccgctttcatagacgtagctttccagccta

SEQ ID NO: 14486 - DNA, 495 bp, Homo sapiens
gactccccatcgagcattgaggcaagaaaacagcaaagccactcaccagtggtcaacaccagcaccttgggagagctaggcagctctgccttatcaaaagccatgaccagctgccaggaaaacaccactctgggatgaaaggagaaaatatggcatcaccagagttgagtcacatccaggcacctgtttgtggcccattccagctccctcacctttcactcctctttctgctgatcccaacctgcgagcatcagttcagtttcagcttgagttcacatctatgtccaagctcacctgtagatccctacacctttccatttcatagggccaaaagaccccaaaagaaaaaaaatcagaaaagaaagacgaggtctcaatgtactttactgggaggatcagacagtaattacataaatgaataggatcatttcagataatgatatttgctgtgaagaaaataaaacaatgtcaaacaaaacatgcaaagccctctta

SEQ ID NO: 14487 - DNA, 435 bp, Homo sapiens
  misc_feature (43)..(43): n is a, c, g, or t
agctgccaggaaaacaccactctgaaaaaaattttgggtaaanaataagggcggcacggaaacaaattcaattgggcggcccccaaaattttcccaccaagaagttgagtcacatccaggcacctgtttgtggcccattccagctccctcacctttcactcctctttctgctgatcccaacctgcgagcatcagttcagtttcagcttgagttcacatctatgtccaagctcacctgtagatccctacacctttccatttcatagggccaaaagaccccaaaagaaaaaaaatcagaaaagaaagacgaggtctcaatgtactttactgggaggatcagacagtaattacataaatgaataggatcatttcagataatgatatttgctgtgaagaaaataaaacaatgtcaaacaaaacatgcaaagccctctta

SEQ ID NO: 14488 - DNA, 412 bp, Homo sapiens
gagttttccccagcttcctcctttcctccaattttccttacaaagcctttccttctttcgtctgagctctaacactttgtacgttgtagtaattttatggagcccagtgccaaacatctctatagaggggatgttgtaagggttgaatatgaagagaccctacatgtgacgtgtgtcctacgaatcttggagtcttgactccttctccagtgtcagtactcgttatctttaatttggggccagatatgagcaccccacacactttccaaaaaagcccccgatccacaaatgtatgcatgatttttccttacataagtcttttcatgtttctggacatattttatctcccttcctcctctaatactttttcccttgctttccacagtgagaaaaacaacaacaacaaaaaaaa

SEQ ID NO: 14489 - DNA, 279 bp, Homo sapiens
ccatgcaatgaatccaagaagagggctattttaaagctcccttcttgagcaacaacaacaaaaaaaataatgcgggcttcaaatgcttgctttttaaaaataagacaaaactgaaaaggttgttaatttagcttcataaagaaagcactgagtttacttaataggttataagggtacactgttatgctaacggtgaacatttctattgtgttaactattcataaacattttgatgggtaaccttcacaccatctgcatgtaaagcaggtatcctttcat

SEQ ID NO: 14490 - DNA, 1934 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttgggagacttggtgttttgtgcttgtctccatgccccttatgggcttggtgaacatagctctgcttctttcctttgtatcagggccaccccttagcattggagccaaacaaacctgaattcaaacctacacacacactgaagtccccatcttcctccttggagccataatgaagagccactacagtcaaatttctgtttgtggcctcccccaacccctcactatggctgattggaaccaaaatggacacctgacccatggtggcccatgctttccctgagaaatcagggcagatccagctttagttttttcctgtggttggacccataacatgggaatatgggaagttttggtggccctcttctccctgccttattgactgagcatcagaaaaagccagtcggctaaggaggaaaaatgaggcagggagaatctaagagttgctggagaatcccagtcactctggagtcccctctctgagcctttcgtgaggccagctgcctcctgcctgggattgaagagatgctcccgaatcctcctaatgcatccccctgttaaaataatctggcttgaggctgggcacggtagctcacacctgtaatcccagcacttcggaaggccaaggcgggaggatctcttgagcccaggagtttgagaccagctgggggaacagagtaagaccctgtctctacaaaaaaaaaaaatttaattagctgggtgtgatggtgcatgcttgtggtcccagctatttgggaggctgaggtgggaggattgcttcagcctgggaggttgaggctgcagtgaaccatgatcacgccactgcattccagcctgggcaacag

SEQ ID NO: 14491 - DNA, 493 bp, Homo sapiens
  misc_feature (3)..(4): n is a, c, g, or t
  misc_feature (49)..(49): n is a, c, g, or t
  misc_feature (57)..(58): n is a, c, g, or t
  misc_feature (60)..(60): n is a, c, g, or t
  misc_feature (62)..(62): n is a, c, g, or t
  misc_feature (68)..(68): n is a, c, g, or t
acnngaaacctggaaatgccgtcataatctaacggcccccccatctcanaatggagnntnancagctnaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14492 - DNA, 1098 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14493 - DNA, 1303 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14494 - DNA, 1105 bp, Homo sapiens
tgtttatcgatgccacccatttttggtgtttatcgatgccacccacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14495 - DNA, 695 bp, Homo sapiens
tacggagctgattattgatgagggagaagatgccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14496 - DNA, 2155 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14497 - DNA, 1273 bp, Homo sapiens
  misc_feature (1109)..(1109): n is a, c, g, or t
  misc_feature (1119)..(1119): n is a, c, g, or t
  misc_feature (1273)..(1273): n is a, c, g, or t
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttgggaaaaaaaaaaanaaaaaaaaanaaaaaaaaaaaaaaaaaaaaaaaaactagagggggggcccgaaaaccaaaaacctcctgggggggcccggatcccaattcaccgtatggggagtcacatcacaatgaattggccaaccttttacaaccccagcattggtgctgacggaatatcn

SEQ ID NO: 14498 - DNA, 2340 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14499 - DNA, 1488 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggacagggccaagaggaccttgcctgcccagtccttggggagctcagatcctacgagactggtacccacaggaggaaatgggtactttagggaagcaggaagaggcgtcggaatcaggaaatcagaagatagcagcttggcaccacgtggcacacatcccctatacacacactggatctcattccagcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14500 - DNA, 2113 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14501 - DNA, 2952 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagagccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttgggagacttggtgttttgtgcttgtctccatgccccttatgggcttggtgaacatagctctgcttctttcctttgtatcagggccaccccttagcattggagccaaacaaacctgaattcaaacctacacacacactgaagtccccatcttcctccttggagccataatgaagagccactacagtcaaatttctgtttgtggcctcccccaacccctcactatggctgattggaaccaaaatggacacctgacccatggtggcccatgctttccctgagaaatcagggcagatccagctttagttttttcctgtggttggacccataacatgggaatatgggaagttttggtggccctcttctccctgccttattgactgagcatcagaaaaagccagtcggctaaggaggaaaaatgaggcagggagaatctaagagttgctggagaatcccagtcactctggagtcccctctctgagcctttcgtgaggccagctgcctcctgcctgggattgaagagatgctcccgaatcctcctaatgcatccccctgttaaaataatctggcttgaggctgggcacggtagctcacacctgtaatcccagcacttcggaaggccaaggcgggaggatctcttgagcccaggagtttgagaccagctgggggaacagagtaagaccctgtctctacaaaaaaaaaaaatttaattagctgggtgtgatggtgcatgcttgtggtcccagctatttgggaggctgaggtgggaggattgcttcagcctgggaggttgaggctgcagtgaaccatgatcacgccactgcattccagcctgggcaacag

SEQ ID NO: 14502 - DNA, 2116 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagagccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 14503 - DNA, 1783 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgcctcaatcgagggaactattgacggactggagcctgggctgcatggactccag

SEQ ID NO: 14504 - DNA, 1842 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccgtaatctcctgaggcaggagaatcacttgaactcaggaggtggaggttgtggtgagctgagattgcaccacggcactccagctcaggggtgacagggcaaaactctgtctcaagaaaaaaaataaaatctgatcttgaaggtcctgcttataaccaccttactgcctctgagatggaaggggacttctggacacagcaaaggaagggtccccatgccatggtgtttgtcatgctgtgatataactagttgtttactcatctgtgagtcccctgagccagaagcttattcaggacaggacccatgtctgattcttctcggtgccctctacccaaagcccagcacagagtaggcctgtttgttgaatgaatgaatgaatgaatgaatgaagcaaatataaatagatgagagggtagagcacctggcctgtgagctgctttcctgcccacctgtttcctttctttcttagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaaggggtgggatgtaaattggcccccaccttgttttttggtgaagggagaagaataactggggcccgggaggggcatccttttttcccaaaaaaaccagggaaaattctcc

SEQ ID NO: 14505 - DNA, 1206 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacaggtgagttgtctgaagtctccccagtagcattctcagctacacattttcacactgggccctcaccaatactctgtgaggcacatacacacaggcacaacctccagatgaggaaactgaggctcacagaggttaaatgacttgccaaaggtccacagcaggtaaaaggtagagttggggtttgagtcaagatctgaccttggctgggcacagtagctcacacctgtaatctagcactttgggaggctgaggtgggcggatcacctgaggtcaggagttcaagaccagcctggccaacatggtgaaaccccatctctactaacaatacaaaaaaaaattagccaggtgcagtggcatgtgcccataatcccagctactagggaggcccagtctttggagagctcagtacagggcaggagctgctgtggtgttcccttggcaaatgaaagttttattttcgtttggga

SEQ ID NO: 14506 - DNA, 931 bp, Homo sapiens
aggaggagggttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcgtgagtgaccactgtggccttggcccctctcggagggaggtggctcagagctggtacaaatctaatcataggattctcaggctctgggttggagtggctttgaggaaggtgtgaaaattatgtgagactccctgcccttcccgagctgctgaagaggtgtgctgggtgaggtggcaagccagcccaagtgtctaataccttgcagagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggggcgagcactttccacttccagagggggccagagggactttgcctgcccagtctttggagagctcagtacagggcaggagctgctgtggtgttcccttggcaaatgaaagttttattttcgtttggga

SEQ ID NO: 14507 - DNA, 448 bp, Homo sapiens
agatggagaagataacgaggcatcaagttgacagaggctgggcagaaggtcccaccctcaggctgaattcactttcttcattactacccctgggcatgtttccagatcttccttcccccacttctagctccctttccagtttttagaatttgaagcatcaagtccttatcaggtgaacttcctgcttccagctggggagcaggccaggctgctgctctcacttctcattatgtacccctttccggcagtatacagcagaatgagaaattgaaagcaaaatgaatttctgccatttcagataagtttataatcttcctagtgaaatatgaagaaatatggagtttggaaagacttaatactcaaagccagaatctgggtcagaaatgaaacaatttcacatctgtgtgtgaatgctgtaggtaatgatgggggaaggtgcttatactga

SEQ ID NO: 14508 - DNA, 303 bp, Homo sapiens
tcatcctctgcctgacatctaatttcttaccctcttgatgagatgacaaattctagatcaggcaacccaggaatgctgtcatctggtaggatccttcatatgtatttatgtgattttatttggtaattgaatttgagaatttaaaatgctcttgatttcagatttacctaaaaaatcatcagggctgggcctggtggctcacgcctgtaatcccagcactttgggaggccaaggcgggaggatcgcttgagctcaggtgtttgagaccaggctgggcaacatagtgagaccctgtctgtctct

SEQ ID NO: 14509 - DNA, 454 bp, Homo sapiens
gtgcagtggtgtgatcttcgctcactgcagccttgacttcctgggcacaatcttccctcttcagccttcaaaatagctgggactacaggcatgcatcactacatctggctaatttttaaagttttgttatatagagacaaagtcttgctatcttgcttaggctggtcttgatctccttgtctcaagtgatcttcccttctgagcctcccaaagtgctgggattacaggtgtgagctgctgtacctgtctgctgctaatatattcctaatgcaggaatacttaaaaggggttctgtgtgataaggataggctgtcagtcctgcccaaatcacctggaagatgctgctgccctggactttcccggcttcaagtttggaaagactcaggccacctgttcaggttatactctatcttttggagtcactgccatctaacacattcataaggttactggt

SEQ ID NO: 14510 - DNA, 1711 bp, Homo sapiens
gaagaggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaagcgtttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaggcttgcagtgactttctgacccatccacctgtttttttgcagattgtcatgaataaaacggtgctgtcacctctgcctgggcctcactgacagcctgcag

SEQ ID NO: 14511 - DNA, 975 bp, Homo sapiens
tgccgtcgattctgaggatcccaaacacatgaagcaatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaagcgtttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaggcttgcagtgactttctgacccatccacctgtttttttgcagattgtcatgaataaaacggtgctgtcacctctgcctgggcctcactgacagcctgcag

SEQ ID NO: 14512 - DNA, 2016 bp, Homo sapiens
gaagaggagaagaggttgtgtgggacaagctgctcccgacagaaggatgtcgctgctgagcctgccctggctgggcctcagaccggtggcaatgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaaggactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggtaagagcgccctgtgtctgaggcagggatgggatgatgggtgcgggagttaaaaaaagggggacgttgcagatggtcccagttccagctctccttccctccattccttcacagtttatgggaaaacgtccatagaatggggatgagtaggtcctagaggggtccgcggagtgctcaaaatccccttctccatctgctggtctgagctgggagctggagtcaggcccagtctccgggacatacaagcccacatgggagtcccaggcacgcttagtctttctctctctctctcaggctgagctgggtgcagttgggggtcccaggccaggttcctgggttgatgggacccaaatgcgggtcttgggcaca

SEQ ID NO: 14513 - DNA, 239 bp, Homo sapiens
ggagttaggtgcctgccatattggtggaggtactaaagaagcaaacagtgctccagagttagctgccaagagaacttgttacaatgaagaagcagtagaagtagaaacttctgtcctaactgcttaattccaagatcacgtcatttgaggcaaaagttggaaaactgagaaactattgccacaactgttgtctcaagaactgtagagccaagcagtagctactaatctgcgccagcaaa

SEQ ID NO: 14514 - DNA, 1148 bp, Homo sapiens
accgacgccggttgctgccggagccgttagagggaggagacaaacgaaccgaggcgggagcggccacgggtgacagcggcagcggcggggccgggctgcgctcccgaaggcgttcctggagggccctgggatggactcagagatccccagagccccaggggacggaaaatctagccccgggcacttgccttggagtctgagtgatgcgcgtcgttggagcgcgaagccggtctccctagcctccgcccgacacagcgtctccaggggttttcctccttttcgcgcctctccttccctcttccccacaccatttgagagcctcaaatggtagtcctgccgccacctctctcccttcgccagcctgccatcgtccccatgggtgcagatatgcgctcccgaagccgcctgcctgccgcgtctgcctcgggcatcagcccacgagtggggagtcggctcagcttgccacgagggaacctcgggttaggaccaatcgcccgggagagagccctcctcgcccccgcacctcctgctccaagtctcctgtcctggttatcccaagttcagggcccacctggggtcacatggggaactacttgtcttaaggctgtaaacaatagttggaagaggagttgctagcttttgagaacttccatgatcatccaaagtctgaaacaaagtaggcggtcagcctttcaaaatacgtgttggaagaaacagacaccttcccatccccagcgtttgttcagtgccttggttgggctttgattctcactgctttgtgaagtacagcttatttttacccccaaaaaaaaaaaaaaaaaaaaaaaaaaaaaaaaaaaaaaaaaaaaaaaaaaacaaaaacaaaaaaaaaaaaaaaaaagagagaaacaaaaaacgaaaaacaacacaagagagaacaatgactcagacaaaagtggtgacccgcagtagagtgatcttctacataacaacactatagtatatgatatcccttcaactactagtcaacaaatctgtcacttactacttcacaaaacatgtaatatttatgaaataactattctaatacaaacttctctacaaaaacgacataatgcaaacaatatactttaaaatatataattaacaaaataactattagcaccatg

SEQ ID NO: 14515 - DNA, 798 bp, Homo sapiens
  misc_feature (13)..(13): n is a, c, g, or t
caagttttcggcncgagggggaggagacaaacgaaccgaggcgggagcggcccgcctgcctgccgcgtctgcctcgggcatcagcccacgagtggggagtcggctcagcttgccacgagggaacctcgggttaggaccaatcgcccgggagagagccctcctcgcccccgcacctcctgctccaagtctcctgtcctggttatcccaagttcagggcccacctggggtcacatggggaactacttgtcttaaggctgtaaacaatagttggaagaggagttgctagcttttgagaacttccatgatcatccaaagtctgaaacaaagtaggcggtcagcctttcaaaatacgtgttggaagaaacagacaccttcccatccccagcgtttgttcagtgccttggttgggctttgattctcactgctttgtgaagtacagcttatttttacccccaaaaaaaaaaaaaaaaaaaaaaaaaaaaaaaaaaaaaaaaaaaaaaaaaaacaaaaacaaaaaaaaaaaaaaaaaagagagaaacaaaaaacgaaaaacaacacaagagagaacaatgactcagacaaaagtggtgacccgcagtagagtgatcttctacataacaacactatagtatatgatatcccttcaactactagtcaacaaatctgtcacttactacttcacaaaacatgtaatatttatgaaataactattctaatacaaacttctctacaaaaacgacataatgcaaacaatatactttaaaatatataattaacaaaataactattagcaccatg

SEQ ID NO: 14516 - DNA, 541 bp, Homo sapiens
aggactcgaggctccgttgtcaggcctgttaaatccagatccgagtcctgcccggaacatctgactctgaccctcccaggtcagcctgagaatctgcatctgtaacaagttccctggtctgctgctgcaggagtgaggcaccccaccctcaggggactcggatggtggtgagggggaagagttgaggtctccgtgtcagccctggagccaaggctaggcccagggtcagactcagctgggtggccttgggtcagttcctcaccctctctggacctcttggaccgggattaatagcatagccgcatcgtgaggcgcatgtgacaggggtgcttcttagccaggagagagggcaccttctcaggtaggatctgacgctgtcacctctcagctgctgcctttctgctgtgaccagcggtggggtccccttagggctcacctcaagacttgacacacgccaggcaggggctgggtcgggatccctgcaggagcggagaagcgggggatcaggggcactgctgagggcagttctgtggccaacaca

SEQ ID NO: 14517 - DNA, 336 bp, Homo sapiens
aagcagcaagcagtcctagtgcaggggcctgctgggctagctgtgggcctgagcgtgtttcttcagctctgagtggagaagactcttctgtgaatgggctgcctgggtttccccctctgtggtttgcatcttgtcctctcccttgggctgtagctgcccagcctttcattccagttttcctcctgccttttgcgcagaggttgttctgggcacagagccctggctggggcccctgtggtagagcagaccttggttgaaacagtgaagaagggaaagcttgcctgctaccccctgccacctcagtccatacctttccagtgcctggggcttgctgtg

SEQ ID NO: 14518 - DNA, 5668 bp, Homo sapiens
  misc_feature (1)..(2): n is a, c, g, or t
nnataaactctaaggaagacagtgatggagtgaagtgggctgggggcgatagagaggatggggtggggcaccaggcgagagatgcgaaggaagccagaacgaaaagagagcgaccgaggagagaagagagcagagcaatacaaaagcagcctcggatctagccggagctgcaagcgttaaggggaggcggagagtgacgcggtttgcgtctggagcggctccttggagtccacagcatccaccgccggagcctcgccttcctttctccctctgcagacacaacgagacacaaaaagagaggcaacccctagaccaccgcgaaggacccatctgcaccatgaccgagaccaccaagacccacgttatcttgctcgcctgcggcagcttcaatcccatcaccaaagggcacattcagatgtttgaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggaactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgct

SEQ ID NO: 14519 - DNA, 1058 bp, Homo sapiens
aaggcacaacgagggatgagctgcaccactttgtgttactctctgatggccagcacagggctgcaagtagtggctgcaaaaaccagacaaatagatggaaatccaggaactagaggaaattcaggcctgccaggggctctgggaagtgttgttactctctcagaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatgtgagtagcaaggttattgcctggcacccagctgggactgggagggatgggaagtgtgcatttgattttggcctcctgtcttcacttcttctgagcttctaagagggcagtccgttcacatcactatggtagaaaattctcacctacccccaagctttatctcctactgcatttttacacttactcctcctcaagcttgctccagtaaagcccctgggaaaaaagcaagctgagtcatacagtatctagcaccaaatagtgctggggtatgcatgtgttgccgatggggagaaggaagggagaaaaaaaaatctttgcccttttaagat

SEQ ID NO: 14520 - DNA, 279 bp, Homo sapiens
atctgtgcccctctcccacatcccaaatagctgtcagtgtcaggagtggtacaaggtgagagggggaagggggaggaggacaggagtagaaatgaggtgcttcagaatttccccatcgtaaccagagggcagtttggtagcaggggaagtgtgggtatctagaatcagactcctttatcagggcatggtggcacacgcctgtagtcccagctacttgggaggctgaggtgggaggattgcttgagcctaggaaatagaggctacagtgactgtgatcac

SEQ ID NO: 14521 - DNA, 426 bp, Homo sapiens
atgactgtatgcatgttctgagatatacacacacccattaaagctattgatcttgtgttttacctttatgtgacactttacctttaaagttctctttgtgtgcatgtgtacaggggttgggaagaagcagttcagtatcatttaataagggggagaaacccaaccccaagatacttgatgaaatctaaggaatacagtctaagtaacacctacctgctcctcccaccaatataagaagagctaaaatcattaatgcatgtatgtataggaaaataatgaaagacaaatatggcaaaatgaggtcagttcaaaggatttatctgtgtgctaagagatgagatagaggctagtggcatgagaaaagcaaaaatggaaataagaggaaaatgaataggtagaactgagggcaatgacctggctcattgg

SEQ ID NO: 14522 - DNA, 444 bp, Homo sapiens
atccccatggcacataatacatttcccgttttcacagacagccacaggtcatgaatgcgagaatactgagaggttggagcaatgttcctgggattcataagggggagcaaatgctccaagatacacccatcgcgggttactcaccacctttgcctcttactccattgttttctgactcctctgcgaatacatagagtaagggggctggcctgggaatggtgtcatgttggatgccatttcttccctgaagaaatatattttgattccaatttacatgttactgtagagtcctaaagaaggatataaagaagtagacagatatcaatatattatatatttttatgtgcattaataaaatctaagatgcacacttaaaaaatccacatcagttttctggaggaatgcagttggcagaaggagaaacatattctgatctttttccct

SEQ ID NO: 14523 - DNA, 613 bp, Homo sapiens
acttttttgatatgggcattgaatactgtaaatttctctcttagcactgcttttgttatatgccacaggctttggtatgctgtactttttttcatttcaaaaagtttttaaatttctgtctgaatttctttgttaacctactgattggtcaggctctctgctcttcttgcacaaagaactgggagggactctctggaatttccctatctaagaaagtttaaatgcacttaagaccccctacctagggatctcacaaaataaccaggaaaaatcaaccatctgagaagagaagagactgggagttctcactgcacccagatagacttttcatctagtcttctgagggcagctttaagagattacctgttggactttatctgtataagacaactttagttcctgtgtagttccacccctcactttcctcctgggtccattcatcctccctaatgatttactgtccctcaaaagaattgcctacatcccccatctcttccttatgaaaaagggtatataaatgtctgtaccatgctgggtaattgggtaatcatgatgtgattttcctccatgcatgttaataaatctgtatgccttttcccctattaaacttcct

SEQ ID NO: 14524 - DNA, 319 bp, Homo sapiens
ttctgagagtgagcaaattgtcttgcttatgcacagcagtcttcacaacacatgacatttcagggaaacttcaaaggagtagcagagacagcagcccgagatgtggtttacatattggggagacaattgggagcttatttgcgcttatcttttttcaagttaaaaggcatgacatctactgaaaacagttcctgaggtttaaaagtatacatctgaaaagagatggaatactttgtctaaattctacatttgtcttaatatgcagttacatgttgtcagtttacccacccgcaatgattgctagcacatggcgcaatct

SEQ ID NO: 14525 - DNA, 1541 bp, Homo sapiens
cctaaaaatctgggcaagtggtgtcctaattagttactgagttaaaacaagttcatgaatttaggccttttgggaaagaaagagaatgtaagatttaacctgtaaatgttaagaatagaaccaaagagagggccacagaccattagttgttaagaggtatcaatcttaacagcatattttctcttgtgcaatgaaaagaacaatcgtagctcttttgggcatcttaggtcttttattctttctggatggcttacatcgaatccttgtgatttatttaaagacacatttttcctggagaggagaaagatcttctctaaaatagccttaacactgagaacatattaggcctaattttaaaagtccaattcagataactcctcagaagtaaatgcagcacactaaaattcattatcacaaaacttaatatttgttaatatgtttcctctgtgctaaaaggctgctgctaaccatggtagttagggaggaagagaaagtaaaagacattagtgttcaaaacttacatctttgggggtaaacaagacatatagtacatttaactcctagggaacttagaatatttatggtaggatagaaagagatgattgtggacacacacaagtaccccaaaaggccattatggtctagaataggtttcatagagaggattactaccacctgtgattatatggtatatgaaacatgagattttgtaacctggacattgcttttagctctgttggaaatggtcagtagagcaatttctgaatattttgatggtacggtgttgatggcatcagtccttttctgtggctttcagcccaacttaatacaagaggagttaaaaatagcacccaaaaggggtagctagagcaccctcaccatgcactaaagataaatctaaaaggtgttcaagtacattgaatcaagatgagtaatccaacttctatgttatgtaggatggatggagcacacaaattcttgcaaacattgtagaggtttttttaaacttcatccactaaggatttttttataataattacttttgaaaataaaatctcaactattttccaagttatgagtgtgctgctcttaaccctgtgagatgaaatcttcccatttggattacatatttgtagttctatatcgacatcagcagatggcaatagtatacaaatagtatacagcatgagccttccattgcttttatttctttgtttataagtatactataatccttcatctgaaacccttagggttttagaattcagaattttccccttttcagagagaatatatataatgtagattacataacaccctcaatggggcctggggcaacaccccataatcaaacattagtacattcatagtaactgggattaactatgtaaggcagtaagctacctgccttacatagtttaggtcaatttttgtcacaaacttatggaaaaactaggtttttagaaattttttggatctcagaattcgtgattagggattgctgacctctgtaaggaaactggtgtcaggtctagaatttt

SEQ ID NO: 14526 - DNA, 1230 bp, Homo sapiens
cttttattttatgcaagaagacacccctctcaagacattgaaatcaacagtaaaaccacattataacaaaaatttactctgatttttcaagtattatccacacaatagattttaatacttgtatccatggattgtaactaaccaccatgtattactaaggcgataatgagaagtaacttggcaatctgtacccaaaatgacaaagaacttagtcaaggaaatagacctttaaaagggttaaattactaagctatgattagtaacaccacgtaagcaaaaacaaagaaaaactggcatgcatggtagttcctttcgacacaagtccaagcaatacactgaatacacatgtgatctatttataaatcaaagggcagaggtactttcttaaggccactgatattcctacacccatcaacaatttgctattagccctcagctataatgctaaaagaagcagtggcagtagaagggggtgactaactgaactcttccccaaccttttagcttaactatttatctggtttgctgcctagagataaatggaaaacattactctaaaatacatcaaggtctatttgttcctttaaatactattggttttgaaatagcttattgtctacatgtaagaattaagcaaagacttcggctgtggacaagattagaaaaagaaaaagaagcaaagatgttgaaaacaaagacgtacattgatcattccttaatgcagtaatgtgttaaaaggaaaagatttttaaaccattaagcgcaggaaaacagtaggaaagtgacttcaaaatggaaaatttgacattcagtgactgaagcattggtatgataatttctaacacttgtagaaggtccatgactgtaattttaccaatgaaaagcatttaactgttttggattccaaactagcagcactacaatgctttgctagagctggtaaaatggaaccaaatcgcctcttcaatggatttggtccccttcaaccagctgtagctatgcattgattactacgggacaaccaacgttttcatttgtgaatatcaattacttgccaactaatttcaacttatttacattatgcagactgtgattataatcaaataacttgttactgttaattctacctggaaaagctagaatggttaaagatgtttataaaaagctttatgaaaaatgtatggatgacttaaggatttcaaataaaaattttacttattatggtctctt

SEQ ID NO: 14527 - DNA, 351 bp, Homo sapiens
tatgcatcctatcttctagtgcatttgtttgtgtatttgtgctgtcttccctagtagattgtgagctccttgagggcagggactgtgtctgtttcctctctgtatctctagggactcataccatgttttacacacagtcggcactcagtgtctgttaatgtgaatggaattaagtccctggaggagaaaatataaatgtgtcatcttttctcagtgagaaaacaaaacttccaaagtccatgatgcaatactgacctttttttttttccaaatcttaccctgacattccaggtttgtttcgaaaaattctgggaaaaacttatgtatggaaagaaaataaatttctcattg

SEQ ID NO: 14528 - DNA, 239 bp, Homo sapiens
ggtatgcagcatcagtgtcctctaagccatttccttgcctggtgtctgttcacctaagaccctcattagtgcacataggactccgaaagactgtgagcttgaggctcagcctaattgtgcccacaccaggaccttgggtgtatgtggggagaagcacctctctgttggcagcactccccttccactgggggtcctggcttggtgcatcctggtccttgtaaccagctcagatcactgag

SEQ ID NO: 14529 - DNA, 306 bp, Homo sapiens
gattgaagtaagtataaatatagctagtaatataggctcacctaacttgatatgaaaacgtctttggataataagtggattcctatctaaattcatgagttctcttatgacatttgggttaagcctgaaatggattaatctttttctgataaagtttcataagctgtgatttctctggtgaccacatttaattagatattaaataaactgcttatctttataccaacaggttttatgactgcattttttttctgagctgtatttcctagattaaatagctagcagaagtaaaaaaaataaataaaa

SEQ ID NO: 14530 - DNA, 460 bp, Homo sapiens
tctgagacagggtctcactttgtcacccaggctggagtgcagtgtgatcttggctcactgcagccttaacctccttgggctcaggtgatctccctcctcagcttcccaagtagctgggaatacaggcatgtactatcaagcatggttaattttgtaatttttgtagagatagggtgtccctatgttgcccaggctgggctcaaactcctaagctcaagcgatcctcccaaagtgctggaattacaggtgtgagccatggcgcttggcctgtaataattttttagtacaagttaagtcaccccttattttcaggctcctccttattcttaaagacattctggggaggtccttgtgtttgttatactatctaaactccaggaagagttagtatgtgaataccaggggttattaatataataacactagcacctggataaaatctagtacaggaatagtatcc

SEQ ID NO: 14531 - DNA, 353 bp, Homo sapiens
tctaaatatcagcatgtaataaaaaccaatttatgtgaagaaacatttgtaaacataatatttaaaatctgttttgtttttataaccaaaagtgggatagtttataaatgaaatgacgtaacacttggtatgaaagttttgcttcacaaccaaaatagcaggacttggaacaatttaaaaagttgtgctgaagattagatatttgctcaagagtataaatgatctgcttcttcataggtataatggacagtgggaccttggccaggaagttcttgatgatatcatttatagagcccagctagagcttttttctcaaccactattggtaagttattatcttaactctttattaa

SEQ ID NO: 14532 - DNA, 504 bp, Homo sapiens
ctctccagatgtgtagcgtctgtttcaccacagaacaaggggtttgctgctgcagcagtcctgagcccttgatttaggatgggcagagcactagagctctgctggagaggctatacattttgacagccagagccatctccatggttttcatcagtcatggccctcattttgcattgtgatatgtgagagagaagcggaactaatgaccacacgctctaatgggggattgtacagatacagctgcgggccttttgtatggttggctaagattttagagtctcttgtcttgccccagggattgtgcttctgttgagattcgcagaaagataacctaaagaatcaggagctgtcatttaggaaaagttctacagacaaatgacttattatttggacattttttcatatttttcctctgttataattaacgtttatagaaattttgactgcctgaggttaattatacgtaggtgtgtacatgtagatacaaatgtgtatatataaata

SEQ ID NO: 14533 - DNA, 874 bp, Homo sapiens
attgtattacatagtagtaaggtatgttaatagtataatagtactatagatagtacaatataatacagcaacagtataatatagttagtaaggtattatgtatcaccaagattttttttcattggaaaggtgtaaaagacaaatgggtggtggaggcaggggagtcttttgtccaaccaaagtcagttaaaggagagagagtgagagagagagcctgagttatagagcaggataatctgagtttggacttctcgctgagaatgcttggcatgaaacagtagggatgagccttcttcaccatgactgtctttaggggaatccactaggctgctttaatgctgctctttatgcttctctatttataatgaagtgctgtgagaccctgtagcagagatagtattgttttttgtttcaatatcaactggtactttttctctacaatgaaaaatgttttgtccataatatatatcacctcgtctctggttttattgttgaaaaccacctgacttgcgctccttttcttttcaacattttttattaagaaaatatttggaaggaagcaataatactaaattgcagaattacaaaagggcagcttatacagctaaattttaagatactctgagggacaaagaaataaagccactgatgctgggtaagaaaaatgtgtgacaatggaagtatgcaatgtgatttacttggctggctaccatgtaggaggaataaattctataatcttgccaaaacctaagggaaatgtgaattgaatagcaataaataaccttattggaaacagttgaatgtgatatactgtatcctctagccttaatacatgaaaatttctcattgattgcagcatcagactcaagtagac

SEQ ID NO: 14534 - DNA, 467 bp, Homo sapiens
gaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttggcttgtagctactacgaggagctcccccagggtgaatgtcaatcctgtccttggccaactgtctttatggttgttcctttccttacaagtgtccaggttcagtcttgtgatagagtggcaacataatgtatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaaggcattatgatacattcactctgtacttgccgcacccc

SEQ ID NO: 14535 - DNA, 525 bp, Homo sapiens
cctcactcagctggttacagtgctgggctcaaacccctcattcagaccttgaatgggcagcttacttttctcatttctaggccatataccaccccaaacccctttgttacttttcaaaacatgatatccaagggatatctggccaggggaactctatattcctctttgttgttaaagtagctcagaggaagtagctttactgcaccgttctgaacaaatcagtcatgttaaaacataatgtatggctaatactctggggagtggaatcgaggagggcctggagtgtgtcactttatacttctgtattgtttcagttacttacaatgaatgtttattactttcaaaattaaagaaaaataaatttaaaatactgtgagaaataattggctgctggtccagtatatttcttgctcatattatggtatttttaaaaacctatttttccctaaaatgaattactgtaataatcatagcaaatgccatcctgttaataaaagaaatgattgataatctattcaagaaaat

SEQ ID NO: 14536 - DNA, 1265 bp, Homo sapiens
ctacatggcagttaccagagacacctgactatatatacatgctgtgctttgaaaatctggcttggactaatctaaatgactacctaagaacatttgaatattccctgaagttttattaattgtgagaaagcccttatctttctgtaatgtgaacaatccaaaatgtcaacaaaatgctaatttggaatggctgtccttgacaatctcagcttcctgagggctgcatgctcaggggctgggagtcgtctgtgtagagtcgatggagaccctggctctcttgcacttctgattatcatgggaagcctcgccttggaaatgtgggactggagttgagctgaaaagaaggaaaaactttacctagactctgcagggagcaagttgaaaagcagagaatgggtatattaattatggggtttttgaaaacagcactaagtacttttcagaaaaacttattttgaaataattatggattcataggaaattgcaaaacagtaccgagaaatcccatgtacttaatttactcagtttcctccatttttatgtaactttagttaaatatcaaaccaggatattgatattggtacaatccacagactttattcagatttcattagttttacatgcatgtgtgtggtgtatgtgtgacatttgtgtgtatgtgtgtgtgtgtgtggtgggtcctcggcaattttatcatgtgtagatttgtgtaaccgtcatcagaaccaaggttacagaagagtttcatcaccacaggtttccttaacgctatgccctttctatcatacccttcccacacctccctgcacttccctaaccccttgcaatgaatttgttctccatctctataaatttaccatcttgagaatgctatataaatggaatcatatattatattatctttggggattttttaaaacttagtatccatgaaattgtttcatgtatcaatggtttgtctcttttttattgatgagtagtattccacagtatggatgtaccagagttggtttaaccatttacacactgaaggatatttggattgtttcaagttttttatttattttattttattttttattttttttactattacaaataaagctactatgaacattcagatttttgtgtcgacataaatataaatttttatttctgtgggatagatacccaggaatgtgattcatagattgcatggtaagtggatgtctactttttcaagaaactaccaaaagacccttactattattcttctaaaacttatt

SEQ ID NO: 14537 - DNA, 324 bp, Homo sapiens
ggtctttggggaggggggcgggatccagcctttgttttgttgtgttggggtgggggtgttgtttttctaaaagctacctcttatgtttgtccagttgttcttttgttcctttcccgcctcccattctgctgctcttcctccctcttttccccaacctcccccgaccctcctgaattttggaaagcacatttgcaatattcgtgtttgctttgggacggaccctccgtttcatctcatgctttatgtgtaagagttttttattattattttttctttcctttctctctctgagaaagttgtggctgcgttttgatcttaggtttt

SEQ ID NO: 14538 - DNA, 170 bp, Homo sapiens
gtaccttttcttaacatgttttaaaaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcc

SEQ ID NO: 14539 - DNA, 373 bp, Homo sapiens
gcacagggtaaaacaaacccccatagaaacctcataaccttgacaaagaaaaaaatcatgcttgccttaatagcaaactattgataaaagatttattctccttgagagaaataattaaaaggaggtagaagtcaaatgggagctgggaaagtaactgaaataggtgctgtaaaacctggggaagaccaacagaaaagatgagagaatagcaactcccaggggcatggattgttcatactttgcaatgttagaaaatgtttggctgccacggtggttctgtttagttctggactatgaatctggtgaaaattgtgcaaatggttcatcatgtaagatgcttaataaagatggtgatgctttgcatcctcttaat

SEQ ID NO: 14540 - DNA, 523 bp, Homo sapiens
cgaccaggatgaagaaacttcaggcggagtcccaggagagcagcgcgggatcccagcctcagcctgcccagacggagaggtgcagaccgacctccaagaagatggttctaactcctcccgccctctcttcccattgagaaatggagccccaccgcgacacaggcttggagaagaagtcgagaacgggatgtggcaaggatctctgtcactccaacgctggcctttctggccaagtcacccgtttggcactccttcccggaagcccatggcggtggcattgtgctgtatcccgcctgggctctgacctctacactgtcctccctcttgctctgtctgccatgtttctgacgggcctggatgcttcttggtctggctcagtgtcttccacagagaacacttttgagtccatcagggagaaactgtgtggaaatccatttcgtgaatgttgtcatcataaatcatcaaaatgtcatctgatagaacatatttttctaagttaatttacttatgagacatttacaag

SEQ ID NO: 14541 - DNA, 1476 bp, Homo sapiens
  misc_feature (332)..(332): n is a, c, g, or t
  misc_feature (705)..(705): n is a, c, g, or t
  misc_feature (837)..(837): n is a, c, g, or t
  misc_feature (1127)..(1127): n is a, c, g, or t
  misc_feature (1161)..(1161): n is a, c, g, or t
  misc_feature (1238)..(1238): n is a, c, g, or t
caagaaccagcagttgcaagtggccatttctgatgaaaatactggttgctaaaacttagtctagttctgatgtgtttaaaatccattttttaaaaaaaaaatcctgtttgtgaatcggtgtaaaaatatagtctttccttctaagtgagaggcaagaggtcaggtgaatatggcagatgaggcaaaactctgcagcccaatttgttcaacttttgaagccttaggttgtgcagcatgtggtcaggcgtggtcatggagaagaattgggccctttctgtcgaccagtgctggctgcaggtgttgcaggtttcagtggatgtcatcgatttccngagcatacttctcagttgtcatgggttcgccaggattcagaaagctgtagtggatcagaccggcagcagagaccaccgtgatctttttttggtgcaagtttggctttgggaagtgctttggagcttcttctcagtccaaccactgagctggtcatcactcgttgtcatataaaatccactcttcgtcgcatgtcacagtctgatcgagaaacgattcattgttgttgcatagaataagagaagaccacacctcaaaacagcaattttaaaaaaatttttgctcaactcatgaggcatccacttatcgagcttttttactgttccaatttgcttcaaatgtcgaactactgtagaatggttatcgctgagttcnttggcaacttctcatatagttgtaagaggatcagcttcaatgattgctctcaattggtcattgtcaacttatgcttctcatcttcaaggctctcttctcttttgcagaacttcttagaccactgctgcactntatgttcattagcagttcctgggccaaatgcattgttgatgttgtgagttatatctgccgttttacaacccattttggactcaaataagaaaattgcttgaatttgctttttgtctaacatcatttccatagtctaaaataaatataaaataaacagcaagtactaagtcattagcaaaaacacaaagtgagaaatgtgcattaaaatgatgtgtaacataaccatatttattgaagaatgcattcccacatcattgttgcaaatatgaacagtgcaaaaactgcagttncttttgcaccaacctatttgcatcaacaattttncctaactggtccatgttaagaaatgtgtgtgggccgggtgcagtggctcatgcctataatgtcagcactttgggagnccaaggcaggtggatcccttaggtcaggagttggagaccagcctggccaacatggtgaatctccatctctactaaaaatacaacaattagccagacatggtggcacgcatctgtaatcccagctacttgggaggctgaggcaggagaatcacttgaatccgggaggcagaatttacagttagctgggcgccattgtactccagcctcagtgacaagggaaagctccaaaaaaaaaaaa

SEQ ID NO: 14542 - DNA, 436 bp, Homo sapiens
ctgatgatttcaagtaggtaaagaatagggatgttaaatctcctataatacacacgacagcctctcacaacaaaaaattatttgacccagaatgtcagtagtgctaaggtggaaaaaaccttatgtgaatcaattaaatcagggagaacttcagagcttttttaagacctttatttatatctagatgattgatattttttaggtattcatgaaaatactttcttttacctttcttgtggtaagcacaagataacactttcttgcctggttaaaaatggacaactgctacacttttaaaataatataaagcattcagtaattcaaaccatcctgtcttctgatttgtctgaattagtgtggctttactgcattttcagggcttattattctttcagtagggagactactaagatttcattaaagatagctgaataaa

SEQ ID NO: 14543 - DNA, 156 bp, Homo sapiens
ttacatgctgccactctaaataccccagtacattgttatttgggcagtagatactttatttgtgtgatgacctgtagtatgtcagattttaggagagcaaactccagtgtgaaacagaacagctgttgttctgtacattccaatgatggctgatgc

SEQ ID NO: 14544 - DNA, 941 bp, Homo sapiens
taataataataataataataatagactgactcaaatctaccataaagcacctctactcattttggaatatgtacgtggaattttgcttcaatagctgaaatctaaaaacactctttctgttgcatttgattattcaatcatgataaggtaaatgtaaacagactgtgtagcactctatcacctggagtgaacttagaatttacagcttagagtacatgactaaaagaggaatggagtggaagtgggcagtaggtgtctttggggcaaaaattctataaactggtgttatctaaactatcacattactttgttaaattattgtttcatcacgtatgacctttgtgatttgtcacacattttacttctacatatgcacataattgtaatttttttaactttaaaaagtcaattatgtttaagaaaatttttaaaataagaatgaacgtatgtgatatttactgtgatatttactcgtgtatttacgatttctgatgcccttattttctttacatacatccgtgtatccacctgttaccattttccttctgcccaaagtatttatcatctataccagtgaagaactgttggttcaactgttgtatgtctgaaaatgtgactctttttctgcctccattctgtgaaaaaaaaattgctgcatatagaatttgaggttaacatggttttgtggatttttttcagtattttaaagatgttgctctaatatttctggtttgctttgttcctgctgtcattcttatttttattttctgtacattatgtgtcctctagctgctttaaagattttccctttgtcacttgctttaaccaatttgattttgatatgtagtgtcgatttctgcatgtttctgtgcctgtggtttgctgaacttcttggatccatgaatttgcagtctttatcgaaaatttcagccattatttct

SEQ ID NO: 14545 - DNA, 427 bp, Homo sapiens
ggtctccgctcacgcctggcctgcactgtaagttttaagagtctacttaaaatcttttttgtatgtttattattagtaaatgagtatctacagattgaactaaaaattaaaaactgaagtctatactgagctgaagaaattgtattcagtaattttcacaattcttgtgggttttcactgtaacttaaggataaaagaattggctactttggctgcgtgtggtggctcacacctgtaattccagcactttgagaggccagcgtgggaggattgcttgagcccaggagtttgagaccagcctgggcaacatggtgagactccatctctactaaaaatacaaaaattggctgggtgtgatggtacgcttgtagtcccagctaagctactgggggtggcagtggtggggttctgacgtcgggggtcgctt

SEQ ID NO: 14546 - DNA, 409 bp, Homo sapiens
gacaaaatgccatgccaattttttttaaactggggaaagggacgttcaaatgtctatgggtcagtttctcagcaatacatcctccagtctcctatctgaggagattaagtttgactacctatatctgggaactaagaactgaatgaagaccttcactaaatccctgttttgggaatgtcacctctcagctgagtctagcatccccaagtacaggtcctgcctgattttatttctccagaaaataaacctccaaagttctgctgagaaaggatgtgggagtttaattgttccttatataacctttgaactaatcctcctcttttcacagctctacctctcaacatttgagaacctctaatacctaggctagggtctgtaccacaaaatgactgttgatactgacattcct

SEQ ID NO: 14547 - DNA, 332 bp, Homo sapiens
tttcaaaaaagctctctagctgctacattgagaataaatgtagacatgattatctgctaggagactattgagacttggtgcctgcagtggaatgatagtgagaaatgattctattttggatatgttttaaaaggagaacccacaggatttaccaatagatgtggagttgaggaaaaattatgaattatttagaatattttttgcccaggcaattgaaacaatggacttgccttcaactgagatgaggaaggtagtatatatagcaggttttggatgagatgatatttagaatccatctagtgcacattaagcttcagatgcctttaaaactc

SEQ ID NO: 14548 - DNA, 253 bp, Homo sapiens
cgggggtgggcaaagggaaggcatttcttcacatccttgtactcttctatagtgaggtagggggtatagcttcataaaaagttccctttccctgaagcttcatttcctgaagcttgtttattatcactgaaaaaatgatcattaataatctttccattcaggtctgctggtagttcaatttatgccttttctttaaattcatccatacttgttttgagtaggctgcttgtttaaagttcacaatataccactt

SEQ ID NO: 14549 - DNA, 442 bp, Homo sapiens
cacaaagttgtataattctcaacacaatctaattttagaacattttcatcaccccagaaggaagccttatacccattagcaacccccttcccagccctggcccctggctgccactcatctaggttctgtctctgtggacttgcccgttctagacatttactatgcatggactcatacaacacggggtattttgtagtcgacttcttgcactaagcaaatcagctatgaacatccgtgtaccaaggcttgtgtgggggtgtgtttccattttcttggatatatagacagttctcttttaagagggtttcacatgctgagcttctcggtgtttcaaactgctcgcaggctcgtgtgctctcgctgtcttatgcgtgctgggcttcgtagttctcaagtctgccttccctgtcttcccccagcatttcactgcgctttcccagat

SEQ ID NO: 14550 - DNA, 225 bp, Homo sapiens
tccgcctcccgggttcaagcgattctcctgcctcagccaccgcgcccggcccattatctggattctttagtacctgttcctctagactctacgctccattaaagcaggaactccatctgttgcaacacctagcacagcgtccggcacactgcagttcttcaataaatacttgctgcatgaagccctctcttcaccaccacccccacccctcctcctcgcaaaaaa

SEQ ID NO: 14551 - DNA, 494 bp, Homo sapiens
atgcagggagttccaggagagagagaaagagagagagagtgcagaaacaatcaaaatgtccatcaaactttgaatgggtgaatacattacgttatatttacacaatggaatactgttcaccaataagtaagccatataccacatgcagaggcgtgaatgaatctcaaacgtaatgccaagtgaaagtagtcagatacaaaagagaacatacttgccgggcatggtggctcatacctgtaatcccagcacttttggaggcttgaggtgggcagatcacctgtggtcaggagttcgagaccaccctgaccaacatggagaagcctcgtctctacttaaaaatacagaattagccgggcatggtggcatgcgcctgtaatcccagctactcaggaggctgaggcaagagaatcacttgaacccaaggcagaggttgcagtgagctgagatcacactattgcactccagcctggggaataagagtgcaactccgtctc

SEQ ID NO: 14552 - DNA, 730 bp, Homo sapiens
tcagtggcctttaacataagaaattgggtatatgtatgaataataatttttcttgaatgtaagttctaaacaggatttttttccttcaaccctactccttctgtaaggaaaaagttttaagtatgatacatattatgttgtggatttggtttatgaatgggaaatgccagaagtgcttgcttctgtaatcaaactttaaccacaagatggcagtataactttcccatgtctttaaaaaatttttaaataattactaaattaaattattttttctctcttaatgagaaatgtatacagctaagggatttcaagatagttctaaggaggatgaatattgaaggtactgtactaaatataagaaatattaaagactatttagtgattatttatttattttttgagtcttgctctgtgagtcagcctgagtctgtgcccaggctggagttgcagtgaactgagatcacatcactgcactccagcctgggctacagagttgagactctgtctcaaaaaaaaaaaaaaaaaaaaagaaaagaaaaaaaagaaaaaggaaatatagttaccatgtgtgagaaaaagtgtggtctcatgtaatgccctaaacatatatgtcatgtttcaaaaatctgtagttttaggtgagtttgaggtcagaatgcatttccccctagaacaatgttatgcaattcatgggcaagccacaaaaattttcttccttttttttaaaaaa

SEQ ID NO: 14553 - DNA, 427 bp, Homo sapiens
ttcatcattatcatcttttaaatttgttcatgttttatccccaccctcccaaaagaatgtattagatgtttcaaagattcttcccttagtgtttaattcatttctactttactcagattaacctaaagcagataacctgatattcaggtcaatgttctacaaatagaactacttgcttgcattttaatttgttaattatttgtaataatgaattaagtattatatttttctgcccatcctaattctaggaaaatctctttatataaacaactattcgttagattcagcaaggccactgttgtatcaggaaatttaattaacgtgagtttgtcatccttctggaataccaaggaagtttctgtctattaaggcattctgctaaaaatattgccagctgcaattatgataaaattcatccctggaaatc

SEQ ID NO: 14554 - DNA, 733 bp, Homo sapiens
  misc_feature (35)..(35): n is a, c, g, or t
  misc_feature (38)..(38): n is a, c, g, or t
  misc_feature (47)..(47): n is a, c, g, or t
aactctcgaggatctcggcagctatccggtcaatnctntttcttttnacattttatataatttaaaaaagcagagacgacgtctcacgatgttgcccaggtggtctcgaactcctgagctcaagtgatccttccgtctcggcctcccaaagtgctgggattacagccatgagccaccattccccacctgtcataaccatcttaattgtatttaacaaatgctcaaaacttcataagacagacaccattgttatgcatattttattttaccaaatagtgaggtttcactatattgcccaggctagtcttaaactcctgagctcaagagattctcccacctctgcctcccaaagtgctgggattataggcatgagatgccgcccttggccattattcctgttttatatagatgatgaaactgaaatccagagagtgagagtaatttgcccaaagacacacagctaaaagtggcagagctaggatttgaacccaggctggccggctggctctactcattacacgtcactgcgttgcctcctgaagcgtgtgtcacgaccccactgttaaccacgaccttgatattccatctctccaaaaaacagttagacgtgcctctttgtggatcttgacctttagttacatttcttttcccagcatcttcaaagtctcatctgccttcctcatctcaaaaacgaaaaaagaaagtcacacaatctatgccgttctctctagta

SEQ ID NO: 14555 - DNA, 414 bp, Homo sapiens
aatcatcattctcattgtatagatggacactgaggctcgagaacggaaacgacttcttttgagttgggtgcctctccccccttgccaggcagccgcctttctctgttgccatagcacaaatcacaagggtatttatggaacaaaagctcagaccgctgagatgttcactctgcactttcagcagcactcacattgagatatgagaagactgcaacaagaacaaaagggttgtgccacctcctttggatgtgaagaggatgtgctgacacgtgtgctcgggagccagactttgtggccttggggaaaggactgaatatttctgtgcttcgtcgtttgcatctgtggaatgcaggtgatactgagctcttccttgtgggattattgcctggaaatacaccattataggttcatcgc

SEQ ID NO: 14556 - DNA, 352 bp, Homo sapiens
gtgaatataagaaagtgctatcaaaatgagaacaatcatcatgtcttgagagcaggaacatttaaacattccctaggccacctgtttctagaatcagatattgatgttatttccttggtagcctggcaaaagggagaaaggtaggtttgtatgtagggttatataaatgctggggccatcaagcaatgtagatcctgcttttttcttcccagtgtactcaagagggcttgaaagccatgcatcctaagtaaagtggttgggggatttggaatgaaacagtatcatctgccatgatactgttccttcagtactcttatcttatttaacagcatcacaatccatccagtgaccc

SEQ ID NO: 14557 - DNA, 365 bp, Homo sapiens
cctataggttttcactgttataaataagattgtgatacatttcttctaaaactctgtcctccccaatgcaacaagatggtgccattgctcctgcaggagatgagataccatgcctgaggcagacagcagagtcatcttttgagtctaagatccttgacaagggaactcaacagattcggggtagaaatggggtgcatgtcaggggatggggacattttattggcctgctagacttctcagtgcctttcccttaaatgtcaccagtagcttcacctggttctggaatgaaatacaacacacattagggcttcagaccctcttctctctgaaagcctgccctttgtttttgagacagagtcttgctc

SEQ ID NO: 14558 - DNA, 320 bp, Homo sapiens
aaagtgcatcacaaatgactccactagttattagagccactttatctgtgggggcacccagcagcaggagatctgtctttgctgtcagtgggggacttgctgaggcaataacagtggctcaggcctttggcacacagtttgcagtggagagagaaatataatattgtgggcaggctgaaggtaaatgaggccaggaatcctccagctgtctgtgcttttgaaagaggtgccatcactgagtgacattcagcatttagatctctacccatctaaaccagtcatgccttttccctcaagtaaagcagttatctgttggctca

SEQ ID NO: 14559 - DNA, 399 bp, Homo sapiens
ttctcaccctgttcgctagactcctacctcagcggcttcctctccctatctcacatgcccaccttacagccctggctttacaggcccctctgcttgaaccagtcttccccttgatcatcacttaggttttggctcaaatgtcactcacttcttctggggcacccttccaatatctgctaaagccacctctaccactgtgcatagtgtcagcaaatcatcactaaagaaatcagcagagaactgtggaggcacctgaagagtaaggcgattctcacactcacccaggataaacatccctacaacagtgctggtatgcagtgggtgcttgttgaatgaatgaatgaatgaatgaatgaatggcaaacaaaccaatgaagacaagcgcccttaaatgtaaat

SEQ ID NO: 14560 - DNA, 266 bp, Homo sapiens
tcgggcccttactgtagcaaacattctcttctcacctgggctcagcctgcctctctgttctcaccccaagtctttgttcagatatcacttcctgaggtcttgcctgactgtcatgtaaataattatcatccttctggtggggtgtggtggctcatgtctataatcctagcactttgggagccagaggcggacagatcacttgaggccaggagtttgagaccagcctggccaacatggtgaaattccgtctctactaaaatacaaaa

SEQ ID NO: 14561 - DNA, 347 bp, Homo sapiens
cattgataactaatattttctatttccctctattgttttgtggtggtggtggtggctgtggatgaacatcattctcaaatatattataattcccttcctcatcaagcccagcatgataaacttcagttttgcctgatggttcatcatcttatttctgtgtgtaagattgttggatttgacattaaacatttggaaactattttataattgataacttgtgctttctcagctttgagtaagcgctctcttcttcatcttataccattttatttttatttattattcacttctgcttctgatctgagatctaggaagctggacaaatcccagataagcaagctaaacaa

SEQ ID NO: 14562 - DNA, 500 bp, Homo sapiens
ttatttcctttattttcagatgtcaaagaaagaaatgcagatccttcagttcaactctcagttgcagtaaagccacctacaggatcaggtcatactaaactgaaatgttgttattatccttttctgtaagggaggcagtcaatggtgaatgctggcctcgctgattactcacctggagacctttctgaggatcagttttctcatctagaaaatgggacaactgccagaccactgaagaaaatacagaaaacagccccacacatcagcatgtttggttgctgccagtctacttggatctgagtattttttcttgccatgaatgtgacgtgattatcttctcctacatcacactgaagttttatgaatgatgctttgaagtgggaagggccagagagttaatattttcggcttcttgggccagctggtctcggtggcagctactgagctctgccactgcagcagagaacgggcacaggcgatatggaaatgataggcgcggc

SEQ ID NO: 14563 - DNA, 466 bp, Homo sapiens
agggtctcactctgtcacccaggctggagtgcagtggcgcagtcatggctccctgtaacctcaacctctcagactccagcaatcctcctgcgacagggaggcagtcaatggtgaatgctggcctcgctgattactcacctggagacctttctgaggatcagttttctcatctagaaaatgggacaactgccagaccactgaagaaaatacagaaaacagccccacacatcagcatgtttggttgctgccagtctacttggatctgagtattttttcttgccatgaatgtgacgtgattatcttctcctacatcacactgaagttttatgaatgatgctttgaagtgggaagggccagagagttaatattttcggcttcttgggccagctggtctcggtggcagctactgagctctgccactgcagcagagaacgggcacaggcgatatggaaatgataggcgcggc

SEQ ID NO: 14564 - DNA, 448 bp, Homo sapiens
gtctcaactaaatcacaaaaatcaaaaccataacaaccacactgttggaccacagctcaagcacaaccagcttctgagtgacttttggttaaagaataaaattaaggcagaaatttaaaaaaattatttgaaactaataacagacacaacataccagaatcttcaggacacaactaaagaaggatgaagaggaaagtttatagtgctgtacacctacctcaagaagttagaaagatctcaaattaagactctaattattgcacctagaggaaccagaaaaacaagagaaaacaaatcccaaagccagcagaaaaaaagaaattacaaaaattagagcagaactgaacaaaactgaggcatgaaaatccatacaaaagatcagcaaaaccaaaagttgattcttcagaagattaaacaagtttgatagcctggtgcctagatttataag

SEQ ID NO: 14565 - DNA, 303 bp, Homo sapiens
gtcttctttcctattcgttcaggaagttctactgcataatattatgtggggaagaggggagacctgtttgaagacagggtgggaacagaaattccggtacaaaagtgtgctaacatttgtcagcagttactgagcttctgccaaattcacacctctgctcgttttatcctagaggctacacttcaatcttctctctggttacccaccttccccatttcctaagggacacaacagttccctcaacttctacaagtcctctcccagagattattctcttccaactttgtacaacctattctagat

SEQ ID NO: 14566 - DNA, 483 bp, Homo sapiens
tgctgggattacaggcatgaagcaccaccacacccagcctatttcctcatttaaatgccactttattccatgaagagttttaaaggagctgcaaagcaagatactgtcaatctaaaatgagagacagttgactatttagaagaaaataaagttagatttctatctcagggacttcatacaaaaatatattgtacaggaggccaggcaccgtggctcacgcctgtaatcctagaactttgcgaggccgaggtgggtggttcgcctgagctcaggagttcgggatcagcctgggcaacatggcaaaaccctgtctctaaaatacaaaaaactagccaggtgtggtggcacatgcccgtggtcccagctacttgggaggctgaggcacgagaattgcttgaatctgggaggcggaggttgcagtgagctgagattgtgctactgcactcagcctaggcaacagagtgagactctgtctcaaaaaaa

SEQ ID NO: 14567 - DNA, 659 bp, Homo sapiens
agtaattatgattgaagaaaagatttgggtgaaatctagtgttcttccctgcaaagggggttgttctcacggattcttatggtgccatgtttctcagaatttgtagtttcagttacttatatttgcacacctgactttagatgagctccagaatagcagttactaattaaggatgagcatttagagtagataaaagtggcaggaacagcaagactcactcccagagagcctcactacaggtctaataggtgaggaaattccccatgtttcccatttttcttcattacctccctgtggggcaagcactgccattattcatgagtaaactgtctgagttatagataagtaatgacatgaaacttcacaaacacgctgagcacagtggctcacgcctgtaatcccagcactttgggaagccgacgtgggtgaatcacgaggtcaggagttcgagatcagcctgaccaacatggtgaaaccctgtctgtactaaaaatacaagaaattagctggccatgatggtgggcacctgtaataccagctactcgggaggctgagacaggagaatcgcttgaacttgggaggcagaggttgcaatgagctgagatcatgccactgcactccagcccaggcggcagtgcaagactccatctaaaaaaaga

SEQ ID NO: 14568 - DNA, 475 bp, Homo sapiens
tcagaatgttggaggtgtttcttttccattaaggaaattgaagccattttaatttctatccattttgctgagaatcttgcagaaggcctcactttgaattgccttcagtttagtgaatttttgagttattcattgttgatttttgtccctccattttctttatctttctggaatttctgttatttggatgttggtcctcctggactaacccattgatactgccttttttctgttctcatagccatctctttgcctttctgttctaatttcggtgagacttcctcaactttattttctgaaatgtctatttcatttatcttatgatgttttaaaatctgatctccttttttctcctggatgtcctcatcatagttcttttcatagttgcaatgcaatcttttactgtcaggatttttattataatttcttgtaaaatttcttctctctgtatatttattactaacaaatcatgtct

SEQ ID NO: 14569 - DNA, 615 bp, Homo sapiens
cctgctgtgccccgcccccccaaccgtggccacctctagcaaagctcagccctagctgtggctggagctgtgtcgtctagaaatggccatctgacataatacatgtccaaataagacccaaagtaggacccatcttctcttcctccccactctgaagattgtgtctgtctttgcttttaaatctatctcacccaccttcaaccttgggctccctgaagggtttgttgggagaatggaaaagagtttctcccggctttcctgtctttacaacatcaaacgagtacatagcccttttcctctcaagagttttgctgccagcctgaaggaggccccgtggcaaggcagggctgggaaactgacggaaacatggggaggtggaagaaccttcccaggttcttaagcctggcctcatgtctggcccgcagctcctgactgcttttctctgtggtacctaaatcccagtgggttctctctccacttcttctgtccagggcagcgttctccccgacttcaggtggccccacctgtcctcagctcaggcccttatttcctgctccaagggcgcaggcaggtggatcagcagatgggagctagtattcatccaggtgccccacg

SEQ ID NO: 14570 - DNA, 554 bp, Homo sapiens
ctaacctatccctgcagccagcccagaccttctacaatcatatctaccagtggtgaaaggcagttcaagatgagttggacacaatcaagaaaaatagggaacaaatatgtcatagctcctctctgtctgctgtctatagaaggaggctaatagcagcagatctggtgagggccagtggcccatggacctgcctgccccaaggcagcaatcatgggagtggggtcaaggaaacactaaggaggtacacctgataggactttttaaagaggagtggccagggttctggccggtttgaagcctggagagaatggaatggcatgagttcagttttggggacattcagtggtaagactggtttctgttttctcttctggaagctcatagatacaggatctgctcattcacttgatttgtgcctcttatttgggcttcaggacacatctctggccaatcgcaattaaaacaccatgcccagttagccatcatcgccactcagagctgtctgctttaccgggctaaaaaaaatgatctttatcaccagttgtaagtgactt

SEQ ID NO: 14571 - DNA, 387 bp, Homo sapiens
aacttcccacttaacaggaaatatagggtttgaggaacaagctaaagaacaaacaagtatctacacaaatctaaagaaggggacattctatgtggtaactaagtccgacctcaacaggtccccaaaagggaccagagctctttggagaaattccaggctgggtcagaggacgtatgaagaatattttgttgtaacagaaaggagatgctcaaaagctgatggaggtgtcaaaaggacacaagaactggcttgaaggggctcccaatgcccaaactttgaagcatagaaaagaataatggatcctttgtattttatgagagtgacgattgggtgttcatgtgcaatgtgtgcattgtcaccacgatggcacattactcgtctgatgtg

SEQ ID NO: 14572 - DNA, 416 bp, Homo sapiens
acagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaacacgttggaaggctgaggtgggtggctcacttgaggtcaggagtttgagaccagcctgactaacgtggtgaagccccgtctctac

SEQ ID NO: 14573 - DNA, 697 bp, Homo sapiens
  misc_feature (1)..(1): n is a, c, g, or t
  misc_feature (432)..(432): n is a, c, g, or t
ncaggggttgaaaaaatggagggtgggcagaggtggggtgggctgggacaaaacccagagagcactcttcttaaaggcaggcaaattcagacttgcaatacacattctgctgaacgaagctaatttctgaggaaagtgaggcccagagtggttaagtgattcatgatggtatcagggagggccctgagggttctgatcactcccagcacttgatccaaaggccccaggcccttggaggcatttcagtggctggcttgggttaaaactgcatgacaggcgcctcttaacctgggcctcttgggcctggaaaattggctgctggaagggagaaaggctaagggtagcgtcccagccggtatctcagcaacgcggggttacaggccgcaggatgagtgctccagctgacccagactcaccacttttcagttgtcntgcaagcaagcaaacacttcccaattccaggccagaaatctttctaaactgtggcagccgcttccctttcttcacaagcagacggcactgggtataatttaagctttttcttcatgtctccgtgccatcttgctgaaacatcagctactgttctgtccttcaatgcagacctggcctcaggagattgtaaggtgggtagaaacattggcttttctcataaaggattccagacagtgacgtgtttgggctttttttctttgattta

SEQ ID NO: 14574 - DNA, 367 bp, Homo sapiens
ggagctataggtgcgccccaggcgttttcttttaggcagctttgggatcagtgcaggtcccagggcccagctggactccctttgggactgctctttcttgggacttttcaatacagcagcgttagcaggagggttcatctgtcacataaatatctgatcctcaggggtggcagcccccaagcttttcccactcccagcagatgcagaatagcatgaagatctgtggacaaactgggcaatctgctcctcaatccacccctccctcactttagaatttgaactctctctactgttttgcaaaagtggtttttgtaaaggtagtaaaaggacagaatcgcaaaataaaatggtccagtaggtaaaccca

SEQ ID NO: 14575 - DNA, 414 bp, Homo sapiens
catatctaggaactctttgcctatcccaaggtcacaaagattttctcctatcttttcttctcaaagttttatagttttatgttttacctgtaggtctgtgatccatttagagttaattatttttaaggtataaagtataggttgaatttttttgtagattgtttttgttttgcatatgagcatctagttgttccagcaccatttgttgaaaagaccatcttttctcgattgagtcatccttgtgccttcgcaaaaattaatggactacgcagtgtttgtgtggatctgtttctggactctattctgttccattgttctgcgtatccatcagtattatactgtcttgattgtggcttcacagtaagtcttgaaatcagatagcattaatcttccagctgtgtttttcattaaaaa

SEQ ID NO: 14576 - DNA, 283 bp, Homo sapiens
ttattgagacagagtccccggttgcccaggctggactgcagtggcgtgatctcggctcactgcaagctccgcctcctgggttcacgccattctcctgcctcagcctcccaagtataatgcaagatgaaaattatttacaaataaaggcagcctgtgatgtaagaactcctgagaatggctttcaaaaccaaccagccagctagtcacgggcaagaggttagaactattctgagagctggccttggtggttttaacttagcacattcactcaacgtgacgtcat

SEQ ID NO: 14577 - DNA, 319 bp, Homo sapiens
gagataagaatgacatgtaatttgtgttagaatttgactgttaattgtgtataaagctgtggccttttcaagtcccaacatttggcaggatcgttaattgggggaaagagaggaagtttgaatgaaattacatgtagaaaagatagacatttacataattagcaaagccccttgagttaataaatatgtgttctagttttttgtgggggactggtgaattttgggacacttatgtttttggtaataaagatggcaatttatttgcatttttgtattttaatgttaagcctcattataaaattattttggtctaattttt

SEQ ID NO: 14578 - DNA, 283 bp, Homo sapiens
tttcctgccctcatgttgcctgttcctaaaccaccatggtcccaccctgccccccgccatcctgtgtctataaaggccccagactcagccagcagagaggagaagcagctggatgttaagggacagcttgacggtgtcacttcagagaagaatccatctgcagacacagatgtggccagacttcaggggaagattaccttcccgccccatcccctttccagctccccttcctgctgacagccactttcatcagcaataaaatcccccacatttaccatccttc

SEQ ID NO: 14579 - DNA, 425 bp, Homo sapiens
atgtccatcagtggggcacttccacaataaaccacagtttatccaaacagttgaatactctgcagctttagaaaagaatgaggatgctgtctttgtgcccatacagactgatgtacaaatacacttggaggctgggcatggtggctcacgcctttaatcccagcacttcgagaggccaaggcaggaggattgctttgctcctgaagccaggagtttgagaccagcctggacaacatagcgacaccctgtatttacaaaaaatataaatttttaatcagctgggtgtggcgacactcacctgaagcaccagctatactcaggaggctgaggtgggaggattgcttcggcctgggaggtcaaggctgcagtgagccgtgattgcaccactgcactccaacctgagtgatggagcgagaccctgtctc

SEQ ID NO: 14580 - DNA, 4748 bp, Homo sapiens
  misc_feature (325)..(325): n is a, c, g, or t
  misc_feature (2279)..(2281): n is a, c, g, or t
  misc_feature (3949)..(3949): n is a, c, g, or t
gagcaggctgtttagcaaggctctgaaaggagaccaccgctgtggggagaccgagacccccaagagctgcagcgaagttgcaggatgcaaggcagccatgaggcaccaggggaagatccccgaggagctttcactagatgacagagcgaggacccagaagaagtgggggagggggaaatgggagccagaacccagtagcaagccccccagggaagccactctggaagagaggcacgcaaggggagagaagcatcttggggtggagattgaaaagacctcgggtgaaattatcagatgcgagaagtgcaagagagagagggagctncagcagagcctggagcgtgagaggctttctctggggaccagtgagctggatatggggaagggcccaatgtatgatgtggagaagctggtgaggaccagaagctgcaggaggtctcccgaggcaaatcctgcaagtggggaggaagggtggaagggtgacagccacaggagcagccccaggaatcccactcaagagctgaggagacccagcaagagcatggacaagaaagaggacagaggcccagaggatcaagaaagccatgctcagggagcagccaaggccaagaaggaccttgtggaagttcttcctgtcacagaggaggggctgagggaggtgaagaaggacaccaggcccatgagcaggagcaaacatggtggctggctcctgagagagcaccaggcgggctttgagaagctccgcaggacccgaggagaagagaaggaggcagagaaggagaaaaagccatgtatgtctggaggcagaaggatgactctcagagatgaccaacctgcaaagctagaaaaggagcccaagacgaggccagaagagaacaagccagagcggcccagcggtcggaagccacggcccatgggcatcattgccgccaatgtggaaaagcattatgagactggccgggtcattggggatgggaactttgctgtcgtgaaggagtgcagacaccgcgagaccaggcaggcctatgcgatgaagatcattgacaagtccagactcaagggcaaggaggacatggtggacagtgagatcttgatcatccagagcctctctcaccccaacatcgtgaaattgcatgaagtctacgaaacagacatggaaatctacctgatcctggagtacgtgcagggaggagacctttttgacgccatcatagaaagtgtgaagttcccggagcccgatgctgccctcatgatcatggacttatgcaaagccctcgtccacatgcacgacaagagcattgtccaccgggacctcaagccggaaaaccttttggttcagcgaaatgaggacaaatctactaccttgaaattggctgattttggacttgcaaagcatgtggtgagacctatatttactgtgtgtgggaccccaacttacgtagctcccgaaattctttctgagaaaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatgctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgagggtcacttccggagccagcacaagagggttgtggagcaggtatcatagtcaccaccttgggaatctgtccagcccccagttctgctcaaggacagagaaaaggatagaagtttgagagaaaaacaatgaaagaggcttcttcacataattggtgaatcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattgtggtctttctgtgttaataaaatgtgctctgaataacagaagtgggcctgtattctgattacttctttgtgctggtgatgacagccannnaatgaattatagttcaggcatatctcctgaagctgatatgactacatatagatgtgaaggacacttgattagttgacaagacctgtttatttaggatgcactaatcttggtctcttgcatttcagtcttaccaaaaatcagttttggtgcagtctgagacatggaaagaaaaaaaacaaaccattgaatcattcttgctcctgcaataccgttatactgcttttcagccccaattatccctgagcctgagtcatttctatgtgaagtcaggcgctcaggctgtgaccgtgttaacattttcagatcacgagggagccatttagtacattaatatgtcagaaatgcagtaaatggattacactggggctcgaaggagctcagagttcaagcacattcctacctgcagggcatacacccaggacacattccagatttctgtgctgaaatattggtctttgcagatgattctgggagtctgtgtgagctgacagcaagacatatcctaatatttcccaaattgaccttcctagattatgaatgacctggttagtaggccacaaaatctagtcaagagtgtggctttttcacgtctaccttccctaacagttttggagccatctgggcggaggcgtgtgttagttaggaaaaccggaacagtactagagaattcaacataaggaattgcttaatcaggttttggaaaatggaagaagcacaaaggaggctctggtataatttagagatagtaactgcaggaagtggctcctgttctttggagaaccaagggaagaagttggggttattagaacctattgaaggagaaatttcttgtagtggacactgtagtatgccactcaggtcctccaagactgaagggaataagctccttggggtgctgctggatgatggctctcagctttcagccctctacaggaattaccctccactggaagagacacctttcagctccctcctgaagcaggctatatcaaatgactagtccctgtagggtatggtggctcagctcctttgtcccaaacagggacaatactgaagggccatccaactacggacctgcccatgggggttggctgaactgttggttgagactgcatcatagcccactttctcccttgcccaatcctgcttctttcctttcccttccagaggtaatgatcctgagaccactccctaataagccttttggatgctaatctggattttagagttggcttctcgggaaaccaaaccgttgacaccccctagaaacttgaaaccacatcaaagaagtaccagctggtgctttaacctcagaagcttggagaaggggccctgtggagcagggactcagacccctgaggagtgggtgctgcccagcaggcagtgtaatgggactcattctgaacacgtgaaagaggctggaagctggattcagttgctactagaacatattttgataaagacaccagtaaccttcatttcactaaatccaaaagagaattttcaatcctcaaattagcatcacttgaccctattgaccactttctctttgaataatttctcctgttgactaccatgatgtcacatttttctggtttttttttctcctatacctttggatctcttgtatagattcagtcttcttccagttgctaaaagctgtagttncatccttagtggctagggaaatgcaaattaaaatcacaatgaaatatcactatacacccattagaatagctaaaattaaatggctaaaatgagaagactgaccttaccaactactagcgaggatgcagagtgactggaacttcccgtacattgctgctgggagtataaaatgggacttctcctttggagaatggtttggtagttcctttaaaagttaaacatgtacctaccatatgatattccacttctagatgtttacccagcagaaattcaagcatatgtcctatgaagacttcacaatatttataggtgctttatttgtagtagccccaaagtggaaacatcttgaatgggcatgatttggtgcatggataaacagattgtatatccacacaatgaataacagccacaaaaaagggatgaactattcatacacgaacaacatggatggactgccaaagaattaggctgaatgaaagaagaaaaaaaagactacattttgattatttcatttacatactattccagaaaatacaagtgaatctatagtgacagaaagtgatcagggggtttgctggagatggaaatggggagaggagggacagaaggattgcaagggaacacttggtaactttggggaagagggacgtgttcattttcttgaatgtaataatggatttatgggggtatatatgtcaaaacttaccaaattgtacacttttgttatgtgcagtttattgtgtgtcaattatacctcaataaagttgttaaaaatatagttgcaggtcctcaaagttca

SEQ ID NO: 14581 - DNA, 3477 bp, Homo sapiens
  misc_feature (1008)..(1010): n is a, c, g, or t
  misc_feature (2678)..(2678): n is a, c, g, or t
ccagttgaaaatggaccttggagggaaaaagtacgagaaaccatgaaggatcaagtaagaaggttcagcgaaatgaggacaaatctactaccttgaaattggctgattttggacttgcaaagcatgtggtgagacctatatttactgtgtgtgggaccccaacttacgtagctcccgaaattctttctgagaaaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatgctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgagggtcacttccggagccagcacaagagggttgtggagcaggtatcatagtcaccaccttgggaatctgtccagcccccagttctgctcaaggacagagaaaaggatagaagtttgagagaaaaacaatgaaagaggcttcttcacataattggtgaatcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattgtggtctttctgtgttaataaaatgtgctctgaataacagaagtgggcctgtattctgattacttctttgtgctggtgatgacagccannnaatgaattatagttcaggcatatctcctgaagctgatatgactacatatagatgtgaaggacacttgattagttgacaagacctgtttatttaggatgcactaatcttggtctcttgcatttcagtcttaccaaaaatcagttttggtgcagtctgagacatggaaagaaaaaaaacaaaccattgaatcattcttgctcctgcaataccgttatactgcttttcagccccaattatccctgagcctgagtcatttctatgtgaagtcaggcgctcaggctgtgaccgtgttaacattttcagatcacgagggagccatttagtacattaatatgtcagaaatgcagtaaatggattacactggggctcgaaggagctcagagttcaagcacattcctacctgcagggcatacacccaggacacattccagatttctgtgctgaaatattggtctttgcagatgattctgggagtctgtgtgagctgacagcaagacatatcctaatatttcccaaattgaccttcctagattatgaatgacctggttagtaggccacaaaatctagtcaagagtgtggctttttcacgtctaccttccctaacagttttggagccatctgggcggaggcgtgtgttagttaggaaaaccggaacagtactagagaattcaacataaggaattgcttaatcaggttttggaaaatggaagaagcacaaaggaggctctggtataatttagagatagtaactgcaggaagtggctcctgttctttggagaaccaagggaagaagttggggttattagaacctattgaaggagaaatttcttgtagtggacactgtagtatgccactcaggtcctccaagactgaagggaataagctccttggggtgctgctggatgatggctctcagctttcagccctctacaggaattaccctccactggaagagacacctttcagctccctcctgaagcaggctatatcaaatgactagtccctgtagggtatggtggctcagctcctttgtcccaaacagggacaatactgaagggccatccaactacggacctgcccatgggggttggctgaactgttggttgagactgcatcatagcccactttctcccttgcccaatcctgcttctttcctttcccttccagaggtaatgatcctgagaccactccctaataagccttttggatgctaatctggattttagagttggcttctcgggaaaccaaaccgttgacaccccctagaaacttgaaaccacatcaaagaagtaccagctggtgctttaacctcagaagcttggagaaggggccctgtggagcagggactcagacccctgaggagtgggtgctgcccagcaggcagtgtaatgggactcattctgaacacgtgaaagaggctggaagctggattcagttgctactagaacatattttgataaagacaccagtaaccttcatttcactaaatccaaaagagaattttcaatcctcaaattagcatcacttgaccctattgaccactttctctttgaataatttctcctgttgactaccatgatgtcacatttttctggtttttttttctcctatacctttggatctcttgtatagattcagtcttcttccagttgctaaaagctgtagttncatccttagtggctagggaaatgcaaattaaaatcacaatgaaatatcactatacacccattagaatagctaaaattaaatggctaaaatgagaagactgaccttaccaactactagcgaggatgcagagtgactggaacttcccgtacattgctgctgggagtataaaatgggacttctcctttggagaatggtttggtagttcctttaaaagttaaacatgtacctaccatatgatattccacttctagatgtttacccagcagaaattcaagcatatgtcctatgaagacttcacaatatttataggtgctttatttgtagtagccccaaagtggaaacatcttgaatgggcatgatttggtgcatggataaacagattgtatatccacacaatgaataacagccacaaaaaagggatgaactattcatacacgaacaacatggatggactgccaaagaattaggctgaatgaaagaagaaaaaaaagactacattttgattatttcatttacatactattccagaaaatacaagtgaatctatagtgacagaaagtgatcagggggtttgctggagatggaaatggggagaggagggacagaaggattgcaagggaacacttggtaactttggggaagagggacgtgttcattttcttgaatgtaataatggatttatgggggtatatatgtcaaaacttaccaaattgtacacttttgttatgtgcagtttattgtgtgtcaattatacctcaataaagttgttaaaaatatagttgcaggtcctcaaagttca

SEQ ID NO: 14582 - DNA, 386 bp, Homo sapiens
tcaccttggcttcccaaagtgctgggattacaggtgtgagcgactgtacctggccaactgtatgtcttttgattagagagtttagttgatttacaatcagtgttattattggtaggtaagcactactcctaccattttatttgtcttctggttgttttttggtcttctcttctttctttccttctttcctgtcttccttttagtgaagatgattttctccaatgttacgctttaatttctttttattttttgggtgtccattgtacgttggacatgcacacaatggacacacataaaacacaacaattagtattcggtttgcaaatactatctcgtaacccattattttaaatggatgacaacactgattgcagaaataaacaagc

SEQ ID NO: 14583 - DNA, 1212 bp, Homo sapiens
tgagtaatgaacatgagcctttctgggtagcatttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctgttcaagttagaaagtaagatacaatgcacacaaagccaaattgtcatcattcagctcctattacaggagaactaagagctgcattgaaaattacttgcaaagcttgtaagtggttctgccacttattagccgtgtgaaccttagcaaattacctagcgtctctgagtttcaacttcctcatctgcaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaagcttttgtgcatctaccgctatgtaaaggaagctgatgtcagtagactggggggaaccagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatatgagtgtactctatctgaataaagtatagcctttctacattgcaaaaaca

SEQ ID NO: 14584 - DNA, 489 bp, Homo sapiens
gatctctccttcctgtgtcatcagcttcctgacccttgaactatgacaacattgctcctccctgggtctgcagctccatgactctcaaactagaacagcagcaccagctccttcctggacctccaggtcaatgactctcagacttcaaaggcagcagcagctccacccccaggctccagctctaaaaccctcagatgtgagcagtggcagcaccagctcctttctgcgtctccggcttcatgatccttaaattagaacagcagcgccatcttctccctgcgtctccagctccaggaacctcaaactgcaacaggagcacctgttcctctgggattttcacctccacgaccctgaggtgtcagtggcagcactggctcctcccctgggctgcagctccagaaccctcaagaataatcccttctcatgaaatgtagcagtcaggaaaactgcagaggaagtaaataaataaatgttttctttcaaactgat

SEQ ID NO: 14585 - DNA, 756 bp, Homo sapiens
cacagaatggaatgcttagatcatagaatatgtatatctcagcattatcagatactatcagagatacttccatttcttttttttttgtcaattaccctattcaaagatactaccaaagtggatatagcatgtacatttctactagcaatgtgtgagaatactagttactccacatcttcacctatacatgataacagtttttaaaaaattggctattccagtgtggttgcagtagtctctcattttggtttcaatttatgtttacttgatgatttatgagtttaaatgcctttttgtgtgtttattggctttttagattgcctcttttaaagcacctattcagtccttttccctgttttataggagttcattatgcattctgattatgaatcctttttcagatacatgtacggtattgcagttatcttctctcattctgtggtattttttttactctcttaaaggaatcttttggtgaagatatcatcaattctaatgaaatccagctaatcttttcctttattctaagccagtctcagtcacttatgcctgcaatcccagcactttggaaggctgaggcaggaggattgctcgaggccaggagtttgaaaccaacctgggcaacaaagtgagactctgtctctacaataaaaatggaaaagaaaaaaaattagttttgattgcaccactgcactcctgctaggcaccagagcaaaaccccgtctcaaaaaccaaacaaacaccaccaccaccaac

SEQ ID NO: 14586 - DNA, 502 bp, Homo sapiens
ctgtaaagtctaagtcagactgtccatccagactggaaccccccttttagagtacctggtgtggaaccagccaacatgggaagcatctgcatctccctattagtaaaccagggttaggcagaaacagaccaaggcaaaggcagctgggtgttcagtgccagacaatttctctgctgctgctaagcaaatggcagggtggagtactcaaccctgagatgagtgtgcctgaaaaagacgactactcaaaccactgaagaaacttcttatctgcccccacttggagcgtcatttcagtctttaccaaattagcaacaaaaggaggggtcccctttctagtcaaggggtacagctaacagctccccacctacgaacatccacccagccagaaggttgcccaaagtagcttgctgctgacttaatgacacttgacagtctatcagagagagtcaggcccacctgttttaggcaatatataatttaatagattctaaaaaaagaaaaa

SEQ ID NO: 14587 - DNA, 357 bp, Homo sapiens
tttttcctcctaagcttaatgacaaaagtccagataattattgtgatcttctgtagaccccagggaaaccaggtactacttaaccctgcagagagaatgagccaccacgtcccacaaagccacgtgccctctcagcgcttctctgctggaagcagcttccccagcctcaggctgcatgcccagagcgccctggacggatgacccaggggtgaggcaggtcaccctggcgcagggccacctccagggtgttcatgacaggcaggaaacactgcaggaaagaaagcaagaaagacagagaaagagggaaggaaggaaagaagaaggaaggagggagggaaggaaccataggaattcgaa

SEQ ID NO: 14588 - DNA, 568 bp, Homo sapiens
cagtagctttcttccaggactcttagattagggatcaaatttgtctgtgaggacaagtgaggccaataaatgaaagttatagagaagaagggtccagcccattttgaggaagatatttcaaagctgtcagcctgccctggaaagaactggatggcctcatgaggcagagtccttgatcactgaatgtgtttcatatgtcagccaaatgattacttaaaactccttcaaatctaactgtgactcttaaactactaaatgcttctctgaacaaagaacaattaagttcttcaaaaacagcaccaagtaaaatttagaacaagttttatcttagctcttcaggactgggtatcccttatactctggcatacaataaattggggatagggggcatacatgagaaatgaaattaaaagttcatcagatgaaaatgttttccaaagcagagtttaaggatagttttaccttattgtttatttaaaaccagagggccagaaaaatgtccagctttaagttcagaggtttaaaaggttcagaggtttaaaagtttacactgctaccaaaaaataaa

SEQ ID NO: 14589 - DNA, 494 bp, Homo sapiens
tgaggaataagcgagggtctagtcccctcattcttggagtgtggagacaggggacttgctgctctcaaccagtcctcttacaatgattgtgacctatttaaagcattcagagaagtacagagatggtgataaggaacattggataccaccagccagctttgccaaatctttacattctatatccatattttatacttgcttgaaatttttatttgaagaaatcataggtacagtccaagcaccctgtgaacctccccccacccagagcactcttcctcctgcctttccttgagctactaataatctggtgactatgtccccaaaatgcatatctttatattttaccacagatataattacatatggacgatatataatcttgttttgcatgttttaaaactatgtaagtggatcttgctgtatgtatccctctgttacttccaaaaccttaaaaaacctaaataacattagagatttatagaaattttgagatg

SEQ ID NO: 14590 - DNA, 1047 bp, Homo sapiens
  misc_feature (1047)..(1047): n is a, c, g, or t
ctctaatcagcagcagaacaaacactcacaaagggtctccttccctcctaggacttccttcgctgggcatctggctgggattcttgttggactaatgtacactcaagggcctctgaagaaaatcatggaagcatgtgcaggtacagaataaaacacctttggcatgacaacagcttggaagttcatgttaattttaatgtgaacagaagcaaccccaagtttccctgtggttcagctcaagaattccctaatatgcctgtttttctttttaaaccgaaaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggccctatgagtcaactcacagcttgcggggagtgggccttctcctggcttgttcttgctcataaacaggtcacttcctcatgagagacaggttcacgctccatctctcatgtgatcaggagcctctggctgggcgtttgagaatggacttcaccggagttattacacagcgggaaaagcctatcgcgggagccggtgatgaaggggggcaccaggccctggcacgagggcagagaggggggaagggcatcaccggaaccacggcgggggagacaaagggcaaaagaggacgggcccgcgcccgggcccgcgccgcacgcggn

SEQ ID NO: 14591 - DNA, 3135 bp, Homo sapiens
  misc_feature (1334)..(1334): n is a, c, g, or t
  misc_feature (1550)..(1550): n is a, c, g, or t
  misc_feature (1556)..(1556): n is a, c, g, or t
  misc_feature (1861)..(1861): n is a, c, g, or t
  misc_feature (2179)..(2179): n is a, c, g, or t
  misc_feature (2521)..(2521): n is a, c, g, or t
  misc_feature (2805)..(2805): n is a, c, g, or t
cgtccgctttaaggccctcccctcccgcacccggccccaggaacccggggcgccccggatcgggaacgtgcgtgatgacgcacgtgcgcgcgaagacgtggggacgcaggcgggtcgtagagagcgttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgagtgccttgtcagtctcctctgctctggaagaattctgatatgacatagaaactgctagatgctggcaaataactcctgggtttcgggccatctagacaataaacaactccataatattcaatgcagcagcctctgtagcgcccatctgtttcaaaataaccctaattctgcttacgatgcggaatgctttgttgactggaatttgtcctagttttcttcagcagatttaatgtcataggcctctggttccacctgctggcaganataaataccagaatgaaactcgggtggatatgttcagttgcaagaaaaatccgagctgtagctcaatggttctcaaaggctgatgtacatcggagtcacccgggagctcattaaaactacagcggcctgggctctgtgggaagcccacccaatcagcaactatttcttaaacagccctcctggtgattcacacacccacaccaacgttagcagacnccactncacctggaatgaggggtgcagaacccagcaaggttagggatgattccagaccactatatcctactcatgcccaagagtgacaaagccaccttgagatgcccactcctacctcttccagtttatccaggtaactcttagtggcaaaggccaaagctttattcccttggaactcattttaaaaagaaaaagttcaaagtggagaaaactgatgaaagcactacttatctaagtggtcaaggttaatgtcaccagtgataagtcatgttgacagcacgttgatatgtgatgagggcatttcacctctntggtattcttcaccaaaacccataaccccagtctaaccatgaggacaaatagcagacaaaccagaccgaatgaaattcttcacgatatctgtctgctaccactcaagactgtcaaggtcatgggggtcaagaaaggactcagaaagagccacagaccaaaagagactaaggagacttggtaacaaaatgtactgtggtctccaggattggaccccgaacagaaaaaggaaattagtgaaaaaaactggtgagatctaaatgtctggaatttagttcagaggaatgtatcaatgttggtttcttagtttcgacaaatgnactgtaagatgttaacatttagggaatagacttgtctgcagtatctttgcaacttttacgtaaatttaaaattattccaaaataaaaagtttattaaaaaaatttacaagaaaaaaataaccccatcaaaaagcaggtaaaggatatgaacagatgcttctcaaaagaagacatttatgtggccaagaagcatatgaaaaaaagctcatcatcactggtcattagagaaatgcaaatcaaaaccacaatgagataccatctcatgccagttagaatagcgatcactaaaaagtcaggaaacaacagatgctggagaggatgtggaaaatgggaatgcttgtncactgttggtgggagtgtaaattagttcaaccattgtggaagatagtgtggcgattcctcaaggatctagaactggaaataccatttgactcagcaatccattactgggtatatacccaaaggactataaatcattctgctataaagacacatgcacgtgtgtgcttattgtagcactattcataatagcagacttggggccaacccaaatgcccatcagtgatcgactggataaagaaaatgtggcacatgtacaccatggaatactatgcagccataaaaangaatgagttcatgtcctttgcagggacatggatgaagctggaaaccatcattctcagcacagtaacacaggaacagaaaaccaacaccgcatgttctcgctcataagtgggagttgaacatgagaacacatggacacagagaggggaacatcacagaccagggcctgttgggggctgggggcaaggggaggcatagcattaggacaatacccatgcatctggggcttataacgagatgacaggttgatgggtgcagcaaccaccatggcacacatatacctatgtaacaaacctgcatgttctgcacacgtatcccagaacttaaagtat

SEQ ID NO: 14592 - DNA, 3216 bp, Homo sapiens
  misc_feature (1415)..(1415): n is a, c, g, or t
  misc_feature (1631)..(1631): n is a, c, g, or t
  misc_feature (1637)..(1637): n is a, c, g, or t
  misc_feature (1942)..(1942): n is a, c, g, or t
  misc_feature (2260)..(2260): n is a, c, g, or t
  misc_feature (2602)..(2602): n is a, c, g, or t
  misc_feature (2886)..(2886): n is a, c, g, or t
cagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgagtgccttgtcagtctcctctgctctggaagaattctgatatgacatagaaactgctagatgctggcaaataactcctgggtttcgggccatctagacaataaacaactccataatattcaatgcagcagcctctgtagcgcccatctgtttcaaaataaccctaattctgcttacgatgcggaatgctttgttgactggaatttgtcctagttttcttcagcagatttaatgtcataggcctctggttccacctgctggcaganataaataccagaatgaaactcgggtggatatgttcagttgcaagaaaaatccgagctgtagctcaatggttctcaaaggctgatgtacatcggagtcacccgggagctcattaaaactacagcggcctgggctctgtgggaagcccacccaatcagcaactatttcttaaacagccctcctggtgattcacacacccacaccaacgttagcagacnccactncacctggaatgaggggtgcagaacccagcaaggttagggatgattccagaccactatatcctactcatgcccaagagtgacaaagccaccttgagatgcccactcctacctcttccagtttatccaggtaactcttagtggcaaaggccaaagctttattcccttggaactcattttaaaaagaaaaagttcaaagtggagaaaactgatgaaagcactacttatctaagtggtcaaggttaatgtcaccagtgataagtcatgttgacagcacgttgatatgtgatgagggcatttcacctctntggtattcttcaccaaaacccataaccccagtctaaccatgaggacaaatagcagacaaaccagaccgaatgaaattcttcacgatatctgtctgctaccactcaagactgtcaaggtcatgggggtcaagaaaggactcagaaagagccacagaccaaaagagactaaggagacttggtaacaaaatgtactgtggtctccaggattggaccccgaacagaaaaaggaaattagtgaaaaaaactggtgagatctaaatgtctggaatttagttcagaggaatgtatcaatgttggtttcttagtttcgacaaatgnactgtaagatgttaacatttagggaatagacttgtctgcagtatctttgcaacttttacgtaaatttaaaattattccaaaataaaaagtttattaaaaaaatttacaagaaaaaaataaccccatcaaaaagcaggtaaaggatatgaacagatgcttctcaaaagaagacatttatgtggccaagaagcatatgaaaaaaagctcatcatcactggtcattagagaaatgcaaatcaaaaccacaatgagataccatctcatgccagttagaatagcgatcactaaaaagtcaggaaacaacagatgctggagaggatgtggaaaatgggaatgcttgtncactgttggtgggagtgtaaattagttcaaccattgtggaagatagtgtggcgattcctcaaggatctagaactggaaataccatttgactcagcaatccattactgggtatatacccaaaggactataaatcattctgctataaagacacatgcacgtgtgtgcttattgtagcactattcataatagcagacttggggccaacccaaatgcccatcagtgatcgactggataaagaaaatgtggcacatgtacaccatggaatactatgcagccataaaaangaatgagttcatgtcctttgcagggacatggatgaagctggaaaccatcattctcagcacagtaacacaggaacagaaaaccaacaccgcatgttctcgctcataagtgggagttgaacatgagaacacatggacacagagaggggaacatcacagaccagggcctgttgggggctgggggcaaggggaggcatagcattaggacaatacccatgcatctggggcttataacgagatgacaggttgatgggtgcagcaaccaccatggcacacatatacctatgtaacaaacctgcatgttctgcacacgtatcccagaacttaaagtat

SEQ ID NO: 14593 - DNA, 1637 bp, Homo sapiens
  misc_feature (1637)..(1637): n is a, c, g, or t
cgtccgctttaaggccctcccctcccgcacccggccccaggaacccggggcgccccggatcgggaacgtgcgtgatgacgcacgtgcgcgcgaagacgtggggacgcaggcgggtcgtagagagcgttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggccctatgagtcaactcacagcttgcggggagtgggccttctcctggcttgttcttgctcataaacaggtcacttcctcatgagagacaggttcacgctccatctctcatgtgatcaggagcctctggctgggcgtttgagaatggacttcaccggagttattacacagcgggaaaagcctatcgcgggagccggtgatgaaggggggcaccaggccctggcacgagggcagagaggggggaagggcatcaccggaaccacggcgggggagacaaagggcaaaagaggacgggcccgcgcccgggcccgcgccgcacgcggn

SEQ ID NO: 14594 - DNA, 907 bp, Homo sapiens
  misc_feature (907)..(907): n is a, c, g, or t
ctctaatcagcagcagaacaaacactcacaaagggtctccttccctcctaggacttccttcgctgggcatctggctgggattcttgttggactaatgtacactcaagggcctctgaagaaaatcatggaagcatgtgcaggcggtttttcctccagtgttggttacccaggacggcaatactactttaatagttcaggcagctctggatatcaggattattatccgcatggcaggccagatcactatgaagaagcacccaggaactatgacacgtacacagcaggactgagtgaagaagaacagctcgagagagcattacaagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggccctatgagtcaactcacagcttgcggggagtgggccttctcctggcttgttcttgctcataaacaggtcacttcctcatgagagacaggttcacgctccatctctcatgtgatcaggagcctctggctgggcgtttgagaatggacttcaccggagttattacacagcgggaaaagcctatcgcgggagccggtgatgaaggggggcaccaggccctggcacgagggcagagaggggggaagggcatcaccggaaccacggcgggggagacaaagggcaaaagaggacgggcccgcgcccgggcccgcgccgcacgcggn

SEQ ID NO: 14595 - DNA, 1153 bp, Homo sapiens
cagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggagttttgtttgctttgaaagttcttaacaaccattattgccctggaggctttgtcaacattttgggctttcctgtaccgaacagatttgcttgttgggtcgaacttgtggctattcatttattctcaccagggacaacctgccattttgttctgaagatttgaatagcaacacagatcctaaagaagcttagtaatactgcaaagctaatgattatgactttcatccagagcactatttagaaacacttgcctgtgccaaatggaggaaggtgttcttaacaactcaccccagcaacagcaaaactatttaggcttatccaccacattgatgagagaagtactgttcttaaaatgagagccttgctcggtgtcttttccctttgcatttaaaaataaatgaaattactgaaacactattataa

SEQ ID NO: 14596 - DNA, 486 bp, Homo sapiens
attttctatatatgtaaaattagatacgtacatgtatatgtaaatgttctttaaaaaaactattaaaaacggaagcgattctttaaaaggtagatttccttttatgttgcagtcatagccacgtaagcaatggacctcatattttttttcaacagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggtaagtgggattcacaaacttgttctgaagacaatttccaaggttgtcagccatgtcaccatatggatggcttctcatgcagaggagtgagtgattattgagaaaaaaaaaa

SEQ ID NO: 14597 - DNA, 323 bp, Homo sapiens
gaggcaaaacaaaacaaaaatccatacaaataaagtatctcctccatccatgtttgcactattccttctcattcccccgtccaatgccacaatttggtaagtttgcctcaacacgttttcagttcttaacactgtgataagaataaacaatagatcccgtagtaagatgacctgttaaaaggaatggggcatggcagagatgagtttggatgaggaaaggtgtcagtccgtttgggctgctctaactaagttctgagatgtgtgttaggtaattttgactttggttgaacatcatagagtgcactcacacagacatagatgac

SEQ ID NO: 14598 - DNA, 454 bp, Homo sapiens
tttgcagatgacatgattgtatatttagaaaaccccattgtctcagcccaaaatctccttaagctgataggcaacttcagcaaagtctcaggatacaaaatcaatgtgcaaaaatcacaagcattcttatacaccaataacagacaaaaatgagcgatttaaacttactccctggcatgtgacctctggcaagttagcttctctgagcctctgtttctttatccaataaatggggatcgatcattgcacatccctcacagatttgtgctgaggattaaataacagggaaaagtcccagcagattgttgggcacataggtaggtagaggataaacatttgttcttttcctcagaatatgccaagaaacttggcgggttgggggccagaggctttggcatgtttccgaacctcctttccagttgatgcaggcagttcagtcagcatcaggtgtcac

SEQ ID NO: 14599 - DNA, 934 bp, Homo sapiens
accaggcagtcccaccctgagaagggaccaagcacagaggcggccactgcagccaactgcacagctggacccgggtagggctcctccctcgggacctccagatggctcctcacccttgaggtcccttctttttggtcagagctactctagtcgcacccactcagtcgtgaactggagcagcagccagagagagagtaagacaatggtgaatgagaagaggccaggtgacaggaacctgcaagctcatccatccacaaacatccactgagcacctgccacgggctgggccccgtgcattcaacaacaaaatgaactaaactgagcttccagcagtgatgggacccactcagcatcgccattctgcacagcctatccgcagcccctctccgataacccaccatcatttcccaccaaacaaatgaagaaagagtgcggccttcagttcagtcttcaatgtgtcttcatttgtttgcaaccgctgaacacagctatctgatatcactgtggcctgggactctcagcttccagcaagtgggagccccacctggctcatccacttcaaaagaggattgcatgctaatgaattaatacatacaagaaagtgttgcaaactctacaatcctatataaatcttaagaagattagaagtttaccaaatgctctgtaatgcattttgaagggctatcccttaaaagaaactggaaatcagcaagacaagcttttccttcttttagtgtctttatttagcctgtacgtactacttgcacacattagtttcacagttaattttaccgccttaaaaacaggactcagatcaaaacctaaacatgagaactcagccactgacagtgattttcctggtggctcccggaagtcattgctctcagagcttccatttccccctcccattaagcaaaggaaataggaggggaag

SEQ ID NO: 14600 - DNA, 794 bp, Homo sapiens
accaggcagtcccaccctgagaagggaccaagcacagaggcggccactgcagccaactgcacagctggacccgggtagggctcctccctcgggacctccagatggctcctcacccttgaggtcccttctttttggtcagagctactctagtcgcacccactcagtcgtgaactggagcagcagccagagagagagtaagacaatggtgaatgagaagaggccaggtgacaggaacctgcaagctcatccatccacaaacatccactgagcacctgccacgggctgggccccgtgcattcaacaacaatcttcaatgtgtcttcatttgtttgcaaccgctgaacacagctatctgatatcactgtggcctgggactctcagcttccagcaagtgggagccccacctggctcatccacttcaaaagaggattgcatgctaatgaattaatacatacaagaaagtgttgcaaactctacaatcctatataaatcttaagaagattagaagtttaccaaatgctctgtaatgcattttgaagggctatcccttaaaagaaactggaaatcagcaagacaagcttttccttcttttagtgtctttatttagcctgtacgtactacttgcacacattagtttcacagttaattttaccgccttaaaaacaggactcagatcaaaacctaaacatgagaactcagccactgacagtgattttcctggtggctcccggaagtcattgctctcagagcttccatttccccctcccattaagcaaaggaaataggaggggaag

SEQ ID NO: 14601 - DNA, 499 bp, Homo sapiens
gtcaggaaattgcaaagaagaattcactttaaacacattgtaaaatcgatgtgtctcaggtttcttttctgttcatgcagacaaatgtagacgcaggtaccttccctccatttgcaatggatttatagttatgtctatataatcagtggaaaaaattcttggcagcacattaattgagcccattcagatggcagcaaaagcagtatttcagggtcattggggaatcatttgtaataaattaacctcatcggtttgtcccagatgtgatgcccagggtgctctcaagaccattctgggagcctgcatgctgatgccttctctccagagcatcttctaatgtagcacacgtgtgaaaaaatcctctacttgaatctgtgtctcctccctgaggttacttatggaagcaggagagggactgaaatacttaagaagtgggaaagaattttcaatacataccactgtatgatcaatctaataaaactgatgcctttaaaacatt

SEQ ID NO: 14602 - DNA, 2518 bp, Homo sapiens
  misc_feature (808)..(808): n is a, c, g, or t
atgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgttctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtttttagtagagatgaagtgtcactatgttaccaaggctggtctcaaactcctaaactcagatgatcctcctgcctcggcctcccaaagtgntggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtcaagttttattcaaaattcatttatgaaataatgccaacactgttctaaaaagcaaggagtcaagaaattataaaattcagattaaatcaggaaaacacattagatggaaaattatactatagaatttgagcttattaaaatttattgcata

SEQ ID NO: 14603 - DNA, 1103 bp, Homo sapiens
atgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgt

SEQ ID NO: 14604 - DNA, 2818 bp, Homo sapiens
  misc_feature (1108)..(1108): n is a, c, g, or t
tttctctagtgctgtttggaatacatcccacgtatgtgtgattcaggagtcaaccaaagatatgtgaaatgtttataaataaaatttggggattctcctctctggctttctcttctccaggatttccctctcacattctcagcagctcttgtttccacaatctctgtcctttgtttctcaagatcagaaacagtgcaggttttcgactgtagctttacctgtcccagactggaagcttccctcaggttaaaaggtttgaaaactggagcttgactagtacttgctgttcttttcttccaggtctcaactcctctccagtagctacaagcatttggtcattcttaaggcctttagaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtttttagtagagatgaagtgtcactatgttaccaaggctggtctcaaactcctaaactcagatgatcctcctgcctcggcctcccaaagtgntggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtcaagttttattcaaaattcatttatgaaataatgccaacactgttctaaaaagcaaggagtcaagaaattataaaattcagattaaatcaggaaaacacattagatggaaaattatactatagaatttgagcttattaaaatttattgcata

SEQ ID NO: 14605 - DNA, 2607 bp, Homo sapiens
  misc_feature (897)..(897): n is a, c, g, or t
atgcgaacacaagtatatgaggggttgtgtaaaaattatttttctcttgctgtactacaaagagatagaatcaaactgctttttttcgacatactggtttttctttctgtttttcttctctttcttctatttcttgtggatattatggctaataacacaacaagtttagggagtccatggccagaaaacttttgggaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtttttagtagagatgaagtgtcactatgttaccaaggctggtctcaaactcctaaactcagatgatcctcctgcctcggcctcccaaagtgntggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtcaagttttattcaaaattcatttatgaaataatgccaacactgttctaaaaagcaaggagtcaagaaattataaaattcagattaaatcaggaaaacacattagatggaaaattatactatagaatttgagcttattaaaatttattgcata

SEQ ID NO: 14606 - DNA, 752 bp, Homo sapiens
tgagctcaggagtttgagaccatcctgggcaacatagtgagacctggtctcttgaaaaaaaaaaagtggatggaacttgtagcagagaattttatctacttctcaacctgcttcagaatacccatttgagatgttcccctggaaagatgaacacaatactgcatctgaagccatttcttcccacctaacattcttaaaatgattagagtctaaactttgtcattcattcctaattctggagctctgaggttgaggtgttcagagtttggtgaataattgggtttaagttttaacattttagtaataataaaagcaaacacatacatgttaaggcctgacaataggttgcaatacccatgcattgggactcatacccagcataaatggtgagggactgaacattagtgctttgagcaagaattggttaactacctgagatctctaaaacagtaatttgaattactaatacataaaccacaagtctcttcgaattgttaattgcctaaatttaccctaaaacttagttaacgctgcagtgcctttattaaagcttttttttggggggggggtgggcacagctactccataactttaaattttaaagcatgaaggtgatctagctagtgttagtgcttgagttggtagttacataggctgctcttgaatcgtcctgttttctttgcctagtattagcaccacaggtacatatttgtaaaataagcattaaaagtactttgtccagctaaaaaaag

SEQ ID NO: 14607 - DNA, 343 bp, Homo sapiens
aaggatgtttattccccattggtgtagggagctgatttgataaaggcacattttttgttacaaggttgttctatggcaggcaatttgtagggaaaccaaagcacattctgatagcttacatgcaaggtggaggttttgctacttacctgcaagatctgggtgggcacagctactccataactttaaattttaaagcatgaaggtgatctagctagtgttagtgcttgagttggtagttacataggctgctcttgaatcgtcctgttttctttgcctagtattagcaccacaggtacatatttgtaaaataagcattaaaagtactttgtccagctaaaaaaag

SEQ ID NO: 14608 - DNA, 495 bp, Homo sapiens
cgctcccgatcgggctaaaggcttgccattgttcctgcacggctaagtgcctgggttcatcctaatcaagctgaacattagtcactgggttccacggttctcttccatgacccatggcttctaatagagctataacactcaccgcatggcccaagattccattccttggaatctgtgaggccaagaaccccaggtcagagaacatgaggcttgccaccattttggaagtggcctgccaccatcttgggagctctgggagcaaggaccccctggtaacagtagtagatacatagaatttttaaataaacatacttatattaagggtactcttagggtctatactaagaaattttgcatgcttgtcattaaaagctttgagtccaagtcctgtgtgtgtgtatatgactttgactctaagtcaagtgtaaatgtaactgtatagatatgccatgtatataatgtaaataaaatatatacatatatttataaataagg

SEQ ID NO: 14609 - DNA, 755 bp, Homo sapiens
aaaccatgtccattcattgggaagatccagcccacatgcccttgtgcctattaatcctgcaaaaaaggatactgcccacacaaactcccctgagggtggccttggcagctggtggtggtgcctgtctctgcccacacagactgcctcgccactgccaggtcccacgtagagctccagtctctaacttcccagaaacaaacctaactaacagctaacctggtgtcttgcctgactgactgcagtttgttttttttttttttctttacaacaaatattaattgctttgccttatttcccatagtgtagaaaccttgagtcttttcaagcctcctgagtacaaattctttacttggaaactttttgtactattgagtgagatcaaaggcttttagacttggtcccagtggggtggtgcttgaagtgacataggaagggattcacagcttctctggaaatagtacacctgagctacagaaattgttcttgttacattgaaaactggacaggtgggtttccttgtgggcatggggctgtgggaagctgcagaggagcatctgttggaacccttatgctcctgggactcaggtgtgtggatagccaacacagaagttaactgacaccaccaggcttattactggttgaagagaaatgagacttgtcaatgggctagggccgggcggctctcagggagactgctaggcttgtgctctccctccctggcctctctagtgtgaggtctttttgcctctcttggc

SEQ ID NO: 14610 - DNA, 412 bp, Homo sapiens
tttaaactgattgaatcagcccactcagattaaagtctgaccgggcacagtggctaacccctgcaatcccagcactttggaaggccaaggcaggtggatcacttgagctcaggagtttgagaccaaccgtgcaacataatgaaaccccgtctctacaaacaaattagccaggcgtggtggcatgtacctgtagtttccaggaggcagaggttgcagtgagccaagatagtaccactgcgctccagcctaggcaacagagtgagatcctgtctcaaaaaaatttaaaaaaaaaactgaattgtaatcacatctacaaaatgccttcaaagcaacacctagatacagtatctgaataaccaaggactatatcctagtcaagtttaacactatgggaaggaaagaactacacagc

SEQ ID NO: 14611 - DNA, 257 bp, Homo sapiens
cattctgctctcctctcattggctctgttctactcctgtctgcgcacactctttcagcttccctgcaagtggctcgccttggtccctagagcagttacggctctgatgacgtcgtatcctcagagtaacgtggtcattttgagtactgttctgcagcttactttttcttttcctaatcaatgaatcaatgaatatactcttgacaaacattttctccattatgcagtattctattatatgcctatgcgaggatttat

SEQ ID NO: 14612 - DNA, 536 bp, Homo sapiens
  misc_feature (44)..(44): n is a, c, g, or t
  misc_feature (65)..(65): n is a, c, g, or t
  misc_feature (87)..(87): n is a, c, g, or t
  misc_feature (91)..(91): n is a, c, g, or t
  misc_feature (101)..(101): n is a, c, g, or t
  misc_feature (142)..(142): n is a, c, g, or t
  misc_feature (144)..(144): n is a, c, g, or t
  misc_feature (162)..(162): n is a, c, g, or t
  misc_feature (176)..(176): n is a, c, g, or t
  misc_feature (195)..(195): n is a, c, g, or t
  misc_feature (197)..(197): n is a, c, g, or t
ttcgtctatttcatttaaatggaatcatgcagtacattgtgttntgtgtgtgccttcatccactnaatgtctttgagattcattctnggtngtcgcttgtntgagaagctcgtcatgtccatgccgagtagtactccattgntngaatatgccacatttagnttatcattcttctnttacatgacatgctttccnanactctctcactctttctctgtctcactctctcttacacaacacacacactcataagaagacacctatatacatttttttcctgaaccattggtaagtaatttgcacacaggatgtcccttcaccccccagtccaccaatacttcggtgtgtttcctaagaacaaaggccttctggaagtttcacattaattccatactggatctacagtccgagttcagatttcaccaattgtcccaataaagtcctttaggtttttctggcccaggatcacttgtcacttttggttgtcaggtctctttaagtctccttcagccttatgtgttgtcgacctttttttt

SEQ ID NO: 14613 - DNA, 473 bp, Homo sapiens
tctagaggatcgctgtatccccaccctggtgcatgcctgtaatcccagctacttgggagactgaggcaggagaattgcttgaacctgggtaacagagtgagactctgtatcaaaaaaagaaaaaataaagcaaacaaagaacagtttacttgtgtggttacagaaagttagtaaacaggcttttatatgctaataaccatttggactaaggagaagaggatataatatgccaatattgtagaaacttacttgacaagggaacctttactcttggagttcagtgtggaattagggtaggtgttctgttatcaattgtggtacatctatttgatggaatattaagtagtcattaaaacgattattttgaagatgatagcagcgtggaaaatgcctgtataaagacatcagcattcaaattagtttgctacaatgattacaattatggtaaatatccatgcatggaaaattaaaac

SEQ ID NO: 14614 - DNA, 761 bp, Homo sapiens
cagtatgacctcactttaacttgattacatatgtaaagtccctgtttacaaataaggtaacattaacagatacctggattaggacttcagcatattttggaagggggcataattcaacccacaatagatggcagtatttcccaaactaatcttccgattaagtgtaatccctatcaaaatcctggtacttttttttgcagaaattgacacactgatattaaaattcctgacccgaggtcaggagttcgagaacaggctggccaacgtagcgaaaccctgcctctactaaaaatacaaaaattagctgagcgttgtggtgcatgcctgtaatcccagctacttgggagactgaggcaggagaattgcttgaacctgggtaacagagtgagactctgtatcaaaaaaagaaaaaataaagcaaacaaagaacagtttacttgtgtggttacagaaagttagtaaacaggcttttatatgctaataaccatttggactaaggagaagaggatataatatgccaatattgtagaaacttacttgacaagggaacctttactcttggagttcagtgtggaattagggtaggtgttctgttatcaattgtggtacatctatttgatggaatattaagtagtcattaaaacgattattttgaagatgatagcagcgtggaaaatgcctgtataaagacatcagcattcaaattagtttgctacaatgattacaattatggtaaatatccatgcatggaaaattaaaac

SEQ ID NO: 14615 - DNA, 358 bp, Homo sapiens
aaaaaaacaatttggccaaactgacaaaactacacattcatttaacttttgacccacttctaggaatctaccctgaagatacacttccaacaatacgaaaataaatatgcacaaggctgtagcatgtgtgtaatagtaaaatattaggaacaacctaaatgaccatacacaggagagacgctaagctatgatgcactcacacaataaagcacaaggatgagaaagatctctataaactgatttagagtgatttccaagatatatttttagatgaaaaaagcaaagtatggctgggcacaatggctcacaaatgcaatcccagtgctttaggaggccaaggcaggaggatcgcttgaga

SEQ ID NO: 14616 - DNA, 460 bp, Homo sapiens
tgagcctggaggtaaaccccagtcccttggcagccttcctcggacactggctttctaatctttgcacagaaatagcagttaaacccctctctggctttagagatctaaaaatattatttaagaacgaggttccttctcatgatgtcttgttttaactctgaaattctgtggtcacatgtcttggaatcgaatgaacccatccagttccagcgtgtacaacagagtaagagaaagacttggttttatactgagacattctagaaatccaggagttcttctaggcattctgttgctacagaagcactttttctggacactttaagtcgagcagtggtttctgtctgttccgcttacttaagtgaacataagcatgatttgtcttttaaaaggtaactgttttagtactcaggtagaatttgtgctttttccttccctacatactttcctacttaaaaaaaaa

SEQ ID NO: 14617 - DNA, 1243 bp, Homo sapiens
cttgtcttagagtctgctattgggggaacccaaactaaaactggcctctgtacagcaggttgagaggcaatatagcatggtggtcagggacataggctttggagccagagtgcctgggctcaagccctggccccacagtttccttgggcaagtgactgagccattctgtgcctctatttcctcattgataaagtaggcgttgtcgtagcacacacctcatcgagtggtgtggagggttaaagaatatgacacagttaaagtgagtccccaataaatgctgttatttctaagagcatccaaatgtagaggaagtgtgcccctgaggactgagcacaccctgcttttagcctgtcctgcccccagctgaaggtgaaaccttggccgcctgccctcctgaagtcccgccactgctgctgggggttggccaactccgctaccgactgtctctgctctctaagaataggtttccctcacagatggcatctctctggatgctgctagagcatctggtgcttccaactgcacactccagggaggaaggcagtgtggtctgtgccggggagcagggctctgccttccagcagatctgagaggagtcccatttggctccttcctagctgccctccattctctaagacctgtaaaacagggatggccagagggctcttgttgcacagtaagtgctatgcttcctaaatgctagttcctgaaatagaatggtttaacctctacttactaaacacctgctacaatcctgttaattcttttgacatgtaagactaaaataaataaataaataaataaatataaaaaaaaaaaaaaaaaaaaaaaaaaaaaaaaaaaaaaaaaaaaaaaaaacaacaacaaaaaagaagacaggcgggaaagaaaaaaaaacagaagaacaaacaacaacaacagcagcgagcggtgggggcgcggcgcacgccgccgccaggagaacaactgttaacccccaacacagtggtgggggcgggcggcgcgccccacagggagtgagtagcaaagaggagggtgaatatcatgcggtcgctccgagagaacagatgtcggggcagacagaacaaagcagcgcgggggctcacacccccgaaaataaaaaaagccggggcgggcaaaaaaaggggggtctgggaaacacccgcggagaggggtcgcgacgagcgcagaggggggtactaacaaagggggggccacagagacgcgtaataaatagccccgc

SEQ ID NO: 14618 - DNA, 1611 bp, Homo sapiens
  misc_feature (337)..(337): n is a, c, g, or t
  misc_feature (1093)..(1093): n is a, c, g, or t
aaactatgcaattgagcaaaaataaggtgcatattcacattctaatatttttaaaatcttcattataaggctattcctgcttataatgaaatatttacatattagggaaattcttaacaccaaaaaaaaccgtatcatcgaagccaatggggccaggaacttaattgttgccagtaatcaatttttctctcttgttttccacgtctctttctttttctctattactacagccagtagctccactgacacattttaagtactctgcagtgataaaaagaaaagagtcaatattcctgagacatctgaagtaatgactaattggctggactagactcangtgctcatgcctcagccaatcactactgcaaggtcttggggctgatgacaatctccattcagaattcatgtccaaaatgatagaaggaaagatgttatacagatgtgaccgccagggtatttgctgtgagctaggcagccacaccacgttttatttactgttctactactatttttactgttgggcacttgcacagcaccttatatgcttgcttcatttaaattttttattaacctttttatgttgggaactggagcccaaagaagttgtgtgttcccaaagttacccaactaatcaatggcagagcctggatgcataaggaccttgaaagccagaagagcagcttatgtggtaggaaatagataaatatttaaggctttttagccagataatccctatcttatgaaaatgcatataacagactaacaaagcagcaaaagggcgaagcacagtggctcacacctgtaatcccagcactttgggaggccaaggaaggaggactgcttaaagtgaggagttcaagaccagcctgagcagcgtagcaagacctcatctctactaagaataaaagttacctgggcatggtggcatatatccataatcctagctgcttgggaggctgaagtgggaggatcccttgagcccagaacttcaaggctgagcagtgagctctgattatgccagtgcattccagccaggatgacagagcaagactgcatctcaaaaaaaaagaaagaaagaaaaagaaaaggcagnaaaggtaagttcagagacccagaggctggaagtagaaggtccaacatatatttaaaagagtttcaggaggagagaaggaaggagaggtgatctccagagatgatgtctgagaaattttcagacttgaaaaatgtgagttgtcagatcaaaggagtacattgtctcaagcagaataaattttagaaattgagacctgtacatagtaatgaaattaaagaataccaaacataacaaaattatgttaaaagttaccactgagaaaagtcaaattaccctaagagaaatgactatcatcctgtcagcagatttatcaccaacagttgtgacagaagatgatggaaaatattttcaaagtattaagagaccaaaactgagaaactagaattctatacctagctaaaccatctttcaagagaaaggacaaaataaacacattttcaaaatttaggatgcacacatactcattcaaagaagtcctaggaaatatactccaacaagaaaaaagctgaaacctgaag

SEQ ID NO: 14619 - DNA, 1834 bp, Homo sapiens
  misc_feature (337)..(337): n is a, c, g, or t
  misc_feature (1093)..(1093): n is a, c, g, or t
aaactatgcaattgagcaaaaataaggtgcatattcacattctaatatttttaaaatcttcattataaggctattcctgcttataatgaaatatttacatattagggaaattcttaacaccaaaaaaaaccgtatcatcgaagccaatggggccaggaacttaattgttgccagtaatcaatttttctctcttgttttccacgtctctttctttttctctattactacagccagtagctccactgacacattttaagtactctgcagtgataaaaagaaaagagtcaatattcctgagacatctgaagtaatgactaattggctggactagactcangtgctcatgcctcagccaatcactactgcaaggtcttggggctgatgacaatctccattcagaattcatgtccaaaatgatagaaggaaagatgttatacagatgtgaccgccagggtatttgctgtgagctaggcagccacaccacgttttatttactgttctactactatttttactgttgggcacttgcacagcaccttatatgcttgcttcatttaaattttttattaacctttttatgttgggaactggagcccaaagaagttgtgtgttcccaaagttacccaactaatcaatggcagagcctggatgcataaggaccttgaaagccagaagagcagcttatgtggtaggaaatagataaatatttaaggctttttagccagataatccctatcttatgaaaatgcatataacagactaacaaagcagcaaaagggcgaagcacagtggctcacacctgtaatcccagcactttgggaggccaaggaaggaggactgcttaaagtgaggagttcaagaccagcctgagcagcgtagcaagacctcatctctactaagaataaaagttacctgggcatggtggcatatatccataatcctagctgcttgggaggctgaagtgggaggatcccttgagcccagaacttcaaggctgagcagtgagctctgattatgccagtgcattccagccaggatgacagagcaagactgcatctcaaaaaaaaagaaagaaagaaaaagaaaaggcagnaaaggtaagttcagagacccagaggctggaagtagaaggtccaacatatatttaaaagagtttcaggaggagagaaggaaggagaggtgatctccagagatgatgtctgagaaattttcagacttgaaaaatgtgagttgtcagatcaaaggagtacattgtctcaagcagaataaattttagaaattgagacctgtacatagtaatgaaattaaagaataccaaacataacaaaattatgttaaaagttaccactgagaaaagtcaaattaccctaagagaaatgactatcatcctgtcagcagatttatcaccaacagttgtgacagaagatgatggaaaatattttcaaagtattaagagaccaaaactgagaaactagaattctatacctagctaaaccatctttcaagagaaaggacaaaataaacacattttcaaaatttaggatgcacacatactcattcaaagaagtcctaggaaatatactccaacaagaaaaaagctgaaacctgaagaaaaaaataaacaaattagcaagtatcttggttaatatgaatcagtagtatgtttttaagtgctagtattttagaattttaaaaccaggtgaaattaaaatatctattaaaatatggtagatgatggtaggagggagttctgagctaaaatattctggagttattttattcaaaggcaatgaaatattccttcaccttagactttgacaagttatactggtta

SEQ ID NO: 14620 - DNA, 343 bp, Homo sapiens
agctacatgatctttttaagagatagtgaaaagcattgataagatccagtgtcccttcatgataaaaacattaaacaatagggaaagtttggaacttccttaacttgttaaaaagcatctgtaaaaaaacccacggttaacatcatagtggaggattggaggttttcctgctaattcaggaacaagatggacccctcctggcatttctattcaacattgtactggaggatctagtcaggaaaatgaagcccatttttttttttcaaataataaaagcatcgaaattggaaagggagaagtaaaatatacacggataacatgatttaatatgtagaaaattcta

SEQ ID NO: 14621 - DNA, 1209 bp, Homo sapiens
catttttttccttctttctttctttgcccatttttttctttcttttatttggaagttacatgtcttagttctgatgttttaattttataataggtttaacgcatataattcctaatttttaagatgtttaactagttttataacagatttaatttagcatacttaagttaaattgatccttagtaccttgtctcttaccccgcaagtatcaaatgattattgttatttaataccatcagtgtattaaatatatgtttaccaacatgtgtttacagatttttctttttacaaaaaaaaaccctgagttataatgtgcgtagagttaggttcacaaataataagtgtacagatcagtgaattttatatatgtatatggtcctatcaggatatagatttacaacacctcagaagactttgtttttccctactctaggtaattttcactctcaaaaataaccactattcagacctctgtcatgatatattggtccaatcttgatcttcacataaattgagtcataaacaggtatccttttgtgtttgttttatgcagttttaggtcgatgagattcttccatatagtggcatatagcagtacttttttttctatagtattgtataagtatatcacaaattatccattctactgttgatggacatttattttttccagtgtttctgactattacaaataaatctcatttgaacatatctttggtagacataaaaacttacttctcatgaacatacatctggtcagcctaaataatgtcagacagttttgccacatagctgtatcgatttatgttcccatcagaaatatatataagttcatcagctccagatcctcatcacaatttgatattgtcactatagttaattttagccacgtgaaatggatataggtatcttattatggttttaatttgtattactttgatgactaattatattaagcatctttttgtatgcttattggccatttgaataccatattttgtgatgcacctgcacatgtattttgtctatttgggggtaaaggggtggtttctttttttaattaattttgtgagtgtgttaaattatattccgaatatgcatatatattttttcttgtatcagcgatttgcaaatatcctcttccaatctttggcttgctttttcccattggtaattatgtcttttaataaaaagaacctctttatttaa

SEQ ID NO: 14622 - DNA, 167 bp, Homo sapiens
gttctagatctatctgacaccaaaccctgtgtccctcaacactgttgattgctgagtctggtatcatcattttatagaaaataaagcagactgaggaaactgaagtcattctgagtcttagttcatgcatctataaaatgggaataacaatactttcctacctcttt

SEQ ID NO: 14623 - DNA, 4156 bp, Homo sapiens
ggctccttacccacccggagacttttttttgaaaggaaactagggagggagggagagggagagagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaaggtaacaaatattgggtgttcaaggatacaactcttcaacctggttaccctcatgacttgataacccttggaagtggaattccccctcatggtattgattcagccatttggtgggaggacgtcgggaaaacctatttcttcaagggagacagatattggagatatagtgaagaaatgaaaacaatggaccctggctatcccaagccaatcacagtctggaaagggatccctgaatctcctcagggagcatttgtacacaaagaaaatggctttacgtatttctacaaaggaaaggagtattggaaattcaacaaccagatactcaaggtagaacctggatatccaagatccatcctcaaggattttatgggctgtgatggaccaacagacagagttaaagaaggacacagcccaccagatgatgtagacattgtcatcaaactggacaacacagccagcactgtgaaagccatagctattgtcattccctgcatcttggccttatgcctccttgtattggtttacactgtgttccagttcaagaggaaaggaacaccccgccacatactgtactgtaaacgctctatgcaagagtgggtgtgatgtagggttttttcttctttctttcttttgcaggagtttgtggtaacttgagattcaagacaagagctgttatgctgtttcctagctaggagcaggcttgtggcagcctgattcggggctgacctttcaaacccagagggttgctggtcctgcacatgagtggaaatacactcatggggaagcttccatgatgcacagtatctgctgttcttcagtcctttgtctttctttgtcattcagttctaggcctttcctctgcacgctcaatgcccagtaaaatttcaggattaactaaagaagaggagaaaaagaagaaaagattctttcttaaaagtttctaatgttattttccttctgaagtctgagcccatttctggggggagaaaaaaaaagcaaatcagaaaacccacggtttttctttttttctttttttctttttttcttttttggctttaaaacaaagggaaaaaagagtttaaacaaaaaacccacaattgaacttccaggaaagtgtgaagacccaaaacagctttgtctccaaagaagatagctctctgactgctttggatagtctcctacgcaccattttgtcaggtgggagatttggaatacacatgcaggacgttagactgttgggacagccattttccaacaaccaaggggccaaaatatctgcaatatagtaacagccttaataatacatccatttttcgttttatacagctgttctcagctatgtcctcagtgtttcatcgcatttatattcatagctattttcaaacacgaccttttaattgtttttgaagtatttctaaaccccttctttccaccttactcctccatcattgtgataatcttcccaagttgtattaggccattgccccagggcttccatgggtctgtcagggaatattcgttacaaagcagagcaagaaggcagtatgtctctgaagtggattacagtggcagttattttacaaggatttgtgacactagtaacatacccgtgtaaccctttgagaactatcagaccagctttcagagtcttaggattgtcggtcttgcgatctgataaattatagaactgggcaatggtaaaaacagtcacaagttcaagaagttcaggtttttaaaacagatatcctataatgtcatataatttttaaatgatttacaagactacataaatgtgtttataacaaacagaaatgatgttacttgccaaaatttttctggcaaataaaaaaggtattttattaagattctcataaatctgaaattttatttgaaaaactgataatagcctaagtcttcttttcttttttttaggcatactgaatttctgttttaaaatccattgcatgaaaattcaatttgccttggtatatgcagttagcattgccattttaaaaatgaattaaaacggtgactctgaagttgcatgaatatcctccagtgcattacctattgcatgtccaccatagttctcaaagggttagtgtggcttctggcatttagccgtccatttgatcactgacagagccaagagaccaccaaagcatttcattgttgagtgtaatttgtcctaacagcagtattgtcattttcatgtgacctgcagagcaggtttgtatcaatatttttttcctagagaaaagtcagcaactgacagacctctttattgatttttaggagctgcttcttgcagtgaaaggctttacagccactgggctgtgaacttattagagatggtcagaatgaatgcaccccatgagtcagacattggctttgtgtgaaagccagctttgaggggattagcttttgaaacaatgaacagcttgccttgaacttgattattgatctattgactgtcattaacaacaacttaaacattgtcttctgtgaaaattttccttgaagagtcctgttctatgtctttgccctttgacctttaacttgcaaactggcacaaactgaaggaaatctggtgttgcttctccattggattagttgttctctaaaacctagtaagcatgagctgtttccttagagtggagagagtggtgatggcagatctgcagatggacactttgctctttacatgcacactctgaaaatgccctataggtagaagtgaattttaatttcattttaatataatttcaagtctaaattcatcattttagtacaaattacaaaaactataggaaaaaaaaaacc

SEQ ID NO: 14624 - DNA, 1644 bp, Homo sapiens
ggctccttacccacccggagacttttttttgaaaggaaactagggagggagggagagggagagagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaagtgaagggagacactctatctgtaatccaagatggttggctctacaaataccattggaaatggattctagaacaaaggcagtcagtgcctgtgctctcaagacaaactgaaaagcacaagacctatgaagaattatcttccatcacatactaacaaagaacaatcaggaattgaaaatttaaaataaaaggccatttacaattgcattcgaaaacaccaaataccgagggatcaatctgcaaaaaatgtgcatgacctctacattgaaaacaacaaaacactactaaatgtttgtctttaaaggcagctgg

SEQ ID NO: 14625 - DNA, 487 bp, Homo sapiens
actaagagaagtcaataagaaaacgataactcttgggagagtccaggagggctggagtcctggtccttggtcttggaaagactcggagaactgctagggagctgggagagaactgtgtggagccatactgggaacctggacccatctgcattttcacatatccaaaacagttccgttcccaagccacccaaatgtgtgagctctcactgcatttctgcttcattactctttgaaatgaaataaggacacagctgtacctcaatttaaatcagtgattgctcttcactctgattctctatggtgcctacaatctatgacaatcaagctgttccacatagaatgaattcttgctgcttttctaggactgtgcctccactagatggaaagttaagcattccatcaaataattgcaatggggatggttggtggttgtggttgctagtcttaatctaccattgaaataaacatttggactgattactcaaaa

SEQ ID NO: 14626 - DNA, 545 bp, Homo sapiens
tgatatgttcaatagaaaagcatcatttaaaaattaatgtagtatatttttcctatagagaaataattgagaacagtaaacacttaaaaaatagtcaaataacaaaaaatgcttttcataggttgctatggtctgaatataacctcttaaaattcacatgttgaagtcctaatcccaacggaaggtattaggaggtagtgccttcaggaagtgattaggtgatgacagtgggattagtgcccttacaaaagtggactgagagagactccctgtccctttcactatgtgaggacatagtgagaaggtgttgtctatgaaccagaaagttggttcttgccaaagaaaggatctacctcgaagttagatttctagcctccagaactgtgagaaataaatttctgtcatgaataaacaacccagtgtgtgatatttgttatggtagccttaacggactaagacacaagtatattgttgtcaggtaagtgtaggaggaggaaagaagaatgcaactagaaggaaaaaaaaaccaatacattaaggaacag

SEQ ID NO: 14627 - DNA, 1320 bp, Homo sapiens
gcgcagcgcgtgcaccagcggctccggagcgagcggccgtggctgagaaggggagggcggaaagtttgtttccccgacgtcagcgccgggcgggccgcgaggctaggaggcggcgggagctgggcagagcgcggggcggccggggctctcgctccgacccgcgcccgcgacccttcctgggacccgagcccgagacccccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagccccaaaaaaaaaaag

SEQ ID NO: 14628 - DNA, 389 bp, Homo sapiens
agcagaggttgcagtgagcctagatcatgccattgaactccggcctgggtgacaagagcaaaactctgtatcaaaaaaaaaaaaaaaaaaaggaaactgtgtcctgtgcagatttgcatctgtgtttattcatgcttaaacctctccagaaggatttgcacacatacatttgtgcacacacacccccagggtgagggaacccagtgtgaaggggccctggacacacaagaccctgggaatagtggttgcctcctcggggagggagccagaaggccaggggacaggggtggtgggacacatttcagtgttaaatgctttcatatgttctgcactatttcccatgtgcatgtgatatttattccaaaataaagttttaaaaaatactaaaa

SEQ ID NO: 14629 - DNA, 322 bp, Homo sapiens
gtcctcctgaaatcgacccttgttaatgttccttctagtaagaggcttaaatgtttgtggagacaacgccattggttgaatgctcctacaaagggcctggatgccagatttcgaaactaaaatacaggacacctagttaaatgtaaattccagatttaaataaagcaaatacttttttagaataagtatgggccatgcagtatttgggacataagtaggcatcctgtattttctctggcaaacctaaacctatatgacatctgccaaaatgggcatatctctgctctgatgttgactctgaccccaacctattttccaggga

SEQ ID NO: 14630 - DNA, 448 bp, Homo sapiens
aataggaaaaagggagagctttgaaactcacatagaaataaaaacggtcttaggggataaaccatatttatattatactacctacgccatttaaggaatgtggttatacattttctgaaaaataaaatgtcctatcctgtcttaaaaaactgaatttgtataatattgggtttgcctaaagagtaaagcacatatactaattttcttttttgttgttattttttctttttttttttttattttgagacagaatctcgctctggagtgcagtggcatgatcccaggtcactgcaacctctacctcccaggttcaagcaattctcttgtctcagcttcccaagtagctgggaccagaggctcctgccaccatgcccagttaatgtttgtatttttagtagagacaatgtttccccatgttggccaggctggtctcgaactcctgacctca

SEQ ID NO: 14631 - DNA, 464 bp, Homo sapiens
ataactcagaagcagtattcatggcttattcatttcgaaagccaccacaagtgatggtttaagctgttccaactttgtgttgttgtttttgaaataaaagaaaggctttttcttttcagtgttaggaaaagggaagacattcaagagagctgaaccaagcgctaagtatcctgaagatctaagatctaaggaccctgaagaccttagatctggctaaaaattataccaagaagcaagtgctgttataatcagagggatagggcaacgctgagcagtgaactcacagagcactcatccattcctttctgacatttgtcattttttatctatgttgtatttatttaagatcatgttttagttacatattgtaactaaaatatctcaaaacagagattgtgtatagtatttctcaaaacagagattgtgtatagtatagaaatactataaatatctcaaaacagaaa

SEQ ID NO: 14632 - DNA, 395 bp, Homo sapiens
ttaatttcttttcctgtaattagctcattcagctttcactgaagttttctagacaagaggactgatgactaaaacagtttgaatatatcctgtgctttcaactgacccagttctgatttcttttccaaggcgcatggataccacagatgtgtgtttttaagggcataaataaatacgtaacttttgaaaagatgtggtatgtattaggcacaaatgtagttgaacccaaaatgatatattttttaggctggtattgataaacaggcagcaattagagttgcattgagtcaccccgaaacggagactttaaactactaaaatccacacacggtagataattcacatattgtaagatcactttaaaaagactgtcaatctgccaggcaaaaagcagc

SEQ ID NO: 14633 - DNA, 577 bp, Homo sapiens
tcctggcctcagtgatgcctcctgatctatccataggcctggaagatcagcactgggatgacgatgagcagaatggtcatgaggatgcccagaatcagggcccagatgttcaggcacttggcggtggaggcataggcctgggccccggtcacgtcgccaaccatcttcctgtccctagacttcacggagtaggcgaatgctatgaagcccaggcagcaggggttcatgaagagggtgttgaacagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctggggcttcatagcatttgcttattccgtgaagtctagggacaggaagatggttggtgacctgactggggcccaggcgtatg

SEQ ID NO: 14634 - DNA, 772 bp, Homo sapiens
ttttttttttgctgttttttcaaaaacatttcttttgacataatgtgagactcacaagaaatggtaccttttaccttctttgatggcaggtaacatcttacataaccatagtacgtttcaaaacagtaaacactggtgcaataattttagctaaactgcccacctcgtttgaattttaccagtttctgagtgcataaatgcactcaatttgactgcatttttgcaggatattttttccaagtatggaattctagggtgacactttttttccttcctgtattttaaagatactgttatactgtctacaatttgtattatttccagtgagaaatcagctatcactacggtggtttttcagtatcctccagctcctctgcagataccaaaatccacaggtaattaagtccctcatattaaatgcctagtagttgtatgtagtctatgcatataggtgcatactcctgtataccttaaatcatctctagattacttatacctaatgaaatataaatgttatatggcattctttatttgtattatttttattgtagtatgatttttttggtgtttgggttttttttcttcccccggtccatgattggttgaatccaagaatgcagaacccatggatacggaaagccaatggtattgttattcctcaaaaatggttttgttttgttttttggtatggctgcttctttgatgtgccttgatgtaattttcttcatgtttattttgcctgtggttcactggacaccttgagtctgtgggt

SEQ ID NO: 14635 - DNA, 806 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14636 - DNA, 843 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggcaaaaaaaaaacaaaaggggcgggcgtcaaaaatatcct

SEQ ID NO: 14637 - DNA, 731 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14638 - DNA, 2000 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtgcaagggcgctgggggaagaggggaacccgggaggatggcgggatgtggagggggcaggcgccggaggaagaaagaaggggcacgagtggccaagcccgtgcaccgttttttgtaaggtatctctttaagcgcctgggaccccaagcgagagtccgaaattagcagagcgctaaaaggaggggcccgaaggcagtggggctttgagctagaagcctctttttacctgcttgacaggtaatttctgtaattggttgtgattgaatttgatagggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttctttcacaccacttaaattagttcccactttaaccttgtttgagattgacttctggagagttaaatgcagatagacttaactctcctaagtcaggtgagactgagagtctccgactgctacaataattacggagcccaaatgcagtaaaacagcctgtttttcaggcaagggttttgtgggggtttttcctaaattaaaacggatcgcctcctacctgctcctatttattgaattaactagtgaattagaaagcattttcaattctaaattcattcaccagttctgagtggtgtgcaacacagtgggtgttttggcttttctcttttactcgctgatagatctacgtgccacttgcctacaacatacttttggcacatagtaggctctgttactccaaagttttccttttttcgagacagtctggctgttgcccaggctgctggagtgcagcagcgagatcgggggtcattgctgcctctgcctcctgggttcaggcgattctcatgcctcagcctcctgagtggctggaattacaggtgcgcaccaccacacccagctaatttttgtatttttagtagagacggggtttcatcatgttggccaggctggcctcgaactcctgacttaaagtgatctgcccgcctcagcctcccaaagtgctgggattacaggcgtgagccaccacacagagcaaaagttttccaaaatgatttttctttcctgttgtagttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14639 - DNA, 1694 bp, Homo sapiens
ggtaccagttcgacggagactctctttaagcgcctgggaccccaagcgagagtccgaaattagcagagcgctaaaaggaggggcccgaaggcagtggggctttgagctagaagcctctttttacctgcttgacaggtaatttctgtaattggttgtgattgaatttgatagggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttctttcacaccacttaaattagttcccactttaaccttgtttgagattgacttctggagagttaaatgcagatagacttaactctcctaagtcaggtgagactgagagtctccgactgctacaataattacggagcccaaatgcagtaaaacagcctgtttttcaggcaagggttttgtgggggtttttcctaaattaaaacggatcgcctcctacctgctcctatttattgaattaactagtgaattagaaagcattttcaattctaaattcattcaccagttctgagtggtgtgcaacacagtgggtgttttggcttttctcttttactcgctgatagatctacgtgccacttgcctacaacatacttttggcacatagtaggctctgttactccaaagttttccttttttcgagacagtctggctgttgcccaggctgctggagtgcagcagcgagatcgggggtcattgctgcctctgcctcctgggttcaggcgattctcatgcctcagcctcctgagtggctggaattacaggtgcgcaccaccacacccagctaatttttgtatttttagtagagacggggtttcatcatgttggccaggctggcctcgaactcctgacttaaagtgatctgcccgcctcagcctcccaaagtgctgggattacaggcgtgagccaccacacagagcaaaagttttccaaaatgatttttctttcctgttgtagttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14640 - DNA, 1638 bp, Homo sapiens
  misc_feature (23)..(23): n is a, c, g, or t
  misc_feature (29)..(29): n is a, c, g, or t
gccgtcgatatcagaacgtcggngagtgncaaaagcagtggggctttgagctagaagcctctttttacctgcttgacaggtaatttctgtaattggttgtgattgaatttgatagggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttctttcacaccacttaaattagttcccactttaaccttgtttgagattgacttctggagagttaaatgcagatagacttaactctcctaagtcaggtgagactgagagtctccgactgctacaataattacggagcccaaatgcagtaaaacagcctgtttttcaggcaagggttttgtgggggtttttcctaaattaaaacggatcgcctcctacctgctcctatttattgaattaactagtgaattagaaagcattttcaattctaaattcattcaccagttctgagtggtgtgcaacacagtgggtgttttggcttttctcttttactcgctgatagatctacgtgccacttgcctacaacatacttttggcacatagtaggctctgttactccaaagttttccttttttcgagacagtctggctgttgcccaggctgctggagtgcagcagcgagatcgggggtcattgctgcctctgcctcctgggttcaggcgattctcatgcctcagcctcctgagtggctggaattacaggtgcgcaccaccacacccagctaatttttgtatttttagtagagacggggtttcatcatgttggccaggctggcctcgaactcctgacttaaagtgatctgcccgcctcagcctcccaaagtgctgggattacaggcgtgagccaccacacagagcaaaagttttccaaaatgatttttctttcctgttgtagttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14641 - DNA, 1611 bp, Homo sapiens
cagtagtcggctatgagttaaacatgcctctctttacctgctgtgaacggtccgtcctgtaataacgttcgtgaattggaaaaaccctggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttctttcacaccacttaaattagttcccactttaaccttgtttgagattgacttctggagagttaaatgcagatagacttaactctcctaagtcaggtgagactgagagtctccgactgctacaataattacggagcccaaatgcagtaaaacagcctgtttttcaggcaagggttttgtgggggtttttcctaaattaaaacggatcgcctcctacctgctcctatttattgaattaactagtgaattagaaagcattttcaattctaaattcattcaccagttctgagtggtgtgcaacacagtgggtgttttggcttttctcttttactcgctgatagatctacgtgccacttgcctacaacatacttttggcacatagtaggctctgttactccaaagttttccttttttcgagacagtctggctgttgcccaggctgctggagtgcagcagcgagatcgggggtcattgctgcctctgcctcctgggttcaggcgattctcatgcctcagcctcctgagtggctggaattacaggtgcgcaccaccacacccagctaatttttgtatttttagtagagacggggtttcatcatgttggccaggctggcctcgaactcctgacttaaagtgatctgcccgcctcagcctcccaaagtgctgggattacaggcgtgagccaccacacagagcaaaagttttccaaaatgatttttctttcctgttgtagttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14642 - DNA, 931 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtgcaagggcgctgggggaagaggggaacccgggaggatggcgggatgtggagggggcaggcgccggaggaagaaagaaggggcacgagtggccaagcccgtgcaccgttttttgtaaggtatctttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14643 - DNA, 631 bp, Homo sapiens
  misc_feature (18)..(18): n is a, c, g, or t
tcgactctcttaatctancaccgctacacttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14644 - DNA, 981 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcggttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtaggagtgaggtggtatggctactgattttcaattggtgacacgttcacagttcagtctaaactggtgggtgggtcttgctgctgtcccgctaacaagacacttccccctacctctgaaagtctgtaaggtcgagatctttcacaagctgttgaccacagtaactcatatgccagtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14645 - DNA, 656 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14646 - DNA, 477 bp, Homo sapiens
ggaaagggtttaccaaaattaaggggtacaataagaacatgtcagaagttcctaattcagtacaacaggagacagctgttgatcttgttgcagaactgcactgatgaaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14647 - DNA, 2276 bp, Homo sapiens
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtgcaagggcgctgggggaagaggggaacccgggaggatggcgggatgtggagggggcaggcgccggaggaagaaagaaggggcacgagtggccaagcccgtgcaccgttttttgtaaggtatctctttaagcgcctgggaccccaagcgagagtccgaaattagcagagcgctaaaaggaggggcccgaaggcagtggggctttgagctagaagcctctttttacctgcttgacaggtaatttctgtaattggttgtgattgaatttgatagggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttctttcacaccacttaaattagttcccactttaaccttgtttgagattgacttctggagagttaaatgcagatagacttaactctcctaagtcaggtgagactgagagtctccgactgctacaataattacggagcccaaatgcagtaaaacagcctgtttttcaggcaagggttttgtgggggtttttcctaaattaaaacggatcgcctcctacctgctcctatttattgaattaactagtgaattagaaagcattttcaattctaaattcattcaccagttctgagtggtgtgcaacacagtgggtgttttggcttttctcttttactcgctgatagatctacgtgccacttgcctacaacatacttttggcacatagtaggctctgttactccaaagttttccttttttcgagacagtctggctgttgcccaggctgctggagtgcagcagcgagatcgggggtcattgctgcctctgcctcctgggttcaggcgattctcatgcctcagcctcctgagtggctggaattacaggtgcgcaccaccacacccagctaatttttgtatttttagtagagacggggtttcatcatgttggccaggctggcctcgaactcctgacttaaagtgatctgcccgcctcagcctcccaaagtgctgggattacaggcgtgagccaccacacagagcaaaagttttccaaaatgatttttctttcctgttgtagttcgatatctcaatgcctatactggaatagtgctacttcgatgcagaaaagaattctatcagcttgtgtggtcagctcttcccttcatcacatacttggagaacaaaggacaccgttacccatgctttttcaacacattacatgtgggaggtaggagtgaggtggtatggctactgattttcaattggtgacacgttcacagttcagtctaaactggtgggtgggtcttgctgctgtcccgctaacaagacacttccccctacctctgaaagtctgtaaggtcgagatctttcacaagctgttgaccacagtaactcatatgccagtacaataagaacatgtcagaagttcctaattcagtacaacaggagacagctgttgatcttgttgcagaactgcactgatgaaggtaagcaacactagcccagtgcccactgagcagtgactgaccttaagctgaagaaatcactcccaaagatatctttcatccctgttatctgccttctccaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggca

SEQ ID NO: 14648 - DNA, 1198 bp, Homo sapiens
  misc_feature (1181)..(1181): n is a, c, g, or t
agcgggtttgcacgccggaccgggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtgcaagggcgctgggggaagaggggaacccgggaggatggcgggatgtggagggggcaggcgccggaggaagaaagaaggggcacgagtggccaagcccgtgcaccgttttttgtaaggtatctctttaagcgcctgggaccccaagcgagagtccgaaattagcagagcgctaaaaggaggggcccgaaggcagtggggctttgagctagaagcctctttttacctgcttgacaggtaatttctgtaattggttgtgattgaatttgatagggtagagaattaaatgagggaagctgtgtatacttcctagtaagagctattatatgaccgattacattaacatcatatggaaaaaaattgtcaaaagtactccgggaaagcccttaaatagttggtaaagtacagaacacatgattgtcaatatatgtaaatacaggatgagctaggacagaggggcccttctttcacaccacttaaattagttcccactttaaccttgtttgagattgacttctggagagttaaatgcagatagacttaactctcctaagtcaggtgagactgagagtctccgactgctacaataattacggagcccaaatgcagtaaaacagcctgtttttcaggcaagggttttgtgggggtttttcctaaattaaaacggatcgcctcctacctgctcctatttattgaattaactagtgaattagaaagcattttcaattctaaattcattcaccagttctgagtggtgtgcaacacagtgggtgttttggcttttctcttttactcgctgatagatctacgtgccacttgcctacaacatacttttggcacatagtaggctctgttactccaaagttttccttttttcgagacagtctggctgttgcccaggctgctggagtgcagcagcgagatcagaggttgcagtgagccgagcttgcaccattgcactccagcctgggcaacangagtgaaactccacctc

SEQ ID NO: 14649 - DNA, 760 bp, Homo sapiens
caacaggagacagctgttgatcttgttgcagaactgcactgatgaaggtaagcaacactagcccagtgcccactgagcagtgactgaccttaagctgaagaaatcactcccaaagatatctttcatccctgttatctgccttctccaggagagcgggaagctatccagaagtctgtgacaagaagctgcttactagaggaggaggaggagtcaggtgaggaggctgcagaagcaatggagtgaacctctgctccccacacagctggctacactgctcaggcttcaggcccacttgttgaacagaacaatctgggtagcaacagcatcttccacagttttccaaactggatagctgccaaccagcagacattacccacttgaaatggagtactcagttaaactgaagttgcctttacctagcattccctggtgaagtgttgcaggttgtgaactctgtagacatctttattgcttggctaagagtagatttaataaatgtatctggtttccgtggcatttagcatacttatattacagaaagggcttatggagtccatgcttggccaagtctctgttctctctctatccctagccttggtgggaagactgactccctatgtggtactagttaaacttttttttttgagacagtctcagtctatcacccaggctggagtgtagtggcccagtatcggctcactgcaacctccgcctcctgggttcaagcaattctcccacctcagccttccaagtaactggg

SEQ ID NO: 14650 - DNA, 1851 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14651 - DNA, 2080 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgccctctcgggccccgtgtgtggggagggcaggtgaacttttgtttctgcccccattcaggttcactgagcccttgggttgaactggttcgtgtcccagtctcttacctgccctgagagcctggcaggccaggagtagaatgggtcccaagtctgttgcatgtttgatttggtgggagtgggatgactgcagcaccttatacaaagagctttcattcatcttgttgaacaaa

SEQ ID NO: 14652 - DNA, 1847 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccactttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14653 - DNA, 793 bp, Homo sapiens
aattaaaatggaaggccacagaaaaggggaaaagaggaaataataacagtaatcgttaatccagcaaaaagaaatgaaaagggattacccttctatgtggttttcccttttcatttctttttgctggattaacgattactgttattagacgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggaggacaaggagggtctcctatgctgcccagagcttggttctttgaaacttcctgggctgaaggcggtctcctgcttgggattcctggacgtgccgggcattccggtgtggggcaccttcttctgaagctgtttttc

SEQ ID NO: 14654 - DNA, 904 bp, Homo sapiens
gctggtaccggccggagattagggatctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatattttccggtggccttccaggagggctggacagaatttcagttcggattgaaggaaccaggcggagaggtccagtaagtgccagctgtgtcgaagctgttggttaacccaggttgtgggggcctctgtgcgagggctagtggagagggaaacataagggatgagacctacgtatttggaaaacgcttggatggacgctgtggacactcgcaggaagaaatcgaaattgtccccgaaggtggggcgctcacttgcttctctcctctctcctccggtcaacactttttaccggtgagaagt

SEQ ID NO: 14655 - DNA, 676 bp, Homo sapiens
tggctaggtacgaggctgggtgttcgggcctggctcggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggacatgcgaacgaggccagtactgc

SEQ ID NO: 14656 - DNA, 344 bp, Homo sapiens
tggacagcacaggaaggtggacagcacagaggaggtggacagcacagagaggcaccctgaggcctccagcaccagttccgtcattctcgttcctggggaacccccactctgtcctcttgctgtccagcacagaggaggtggacagcacagggaggtgccaactgcatcatgttcgtcctctgcacccgcgccgtccgaactcggctcttctctctctgttgctgctgctgctcttctcagcctcctctgtgctgtcgacagcacagaggaggtggacagcataggtaggttccacagttactcttcccacaagttcccttaagtcttgccctcctctgtgctgt

SEQ ID NO: 14657 - DNA, 1937 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccactttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14658 - DNA, 1790 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14659 - DNA, 1711 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccactgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14660 - DNA, 1837 bp, Homo sapiens
agacggtgggagtggtggggagaggtcgcccgggtctggggagaccgatgcacaggtggagagatggtgcgggttctgtggattcggatccttacaacttcctcttccccgccccggtagatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14661 - DNA, 1793 bp, Homo sapiens
tggctagtagagcctggggttaatcggccgaggactgtcgagccttcgctgggagccgggcctggctcggcccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14662 - DNA, 2000 bp, Homo sapiens
gtggggcgaccccagcctactcagtccgcggaggccccgcggcgcacgtccgcagcctccatcacagcgcgggcgcgcagacggggctggcatctaccatatggggggcatccgggccgaaccaagtgacccgcgtggggggtcccgctggggactccgtgccgcaccctcccaagccggccccaggggcccagggctggtgtcgcacgttcgctggccgcgctcccagggcccgggtttgaaggcgctgggcaggcaggggcagccccgccccctgagaaggatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14663 - DNA, 1829 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggccctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacggctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14664 - DNA, 1583 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcagcacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14665 - DNA, 1190 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccagacgcctgtgtgagcacaagtatggcaatgcgccccgtgtccgcatcaatggccatgtggctgcccggttcccgcaccctgaggcctccagcaccagttccgtcattctcgttcctggggaacccccactctgacctgttattaaagttcacattttgaatgcc

SEQ ID NO: 14666 - DNA, 1220 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccgatcaaggaccaggcggacgaggcccagtactgccagctggtgcgacagctgctggatgaccacaaggatgtggtgaccctcttggcagagggcctacgtgagagccggaagcacatagaggatgaaaagctcgtccgctacttcttggacaagacgctgacttcgaggcttggaatccgcatgttggccacgcatcacctggcgctgcatgaggacaagcctgactttgtcggcatcatctgtactcgtctctcaccaaagaagattattgagaagtgggtggactttgccaggtgaggcaagaatggctcagggggtgggcagacatctggggcagggaaggcttgggtctgagcccttgcccggggcatgatctgcggggagcagggtttctcaaccatggcactattgacatttccagccagataattctttgtcataggggctgccccgtgcacgttaggaagttcagcagcatccctggcg

SEQ ID NO: 14667 - DNA, 1065 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttcatccctatgccactggactacatcctgccggagctgctcaagaatgccatgagagccacaatggagagtcacctagacactccctacaatgtcccagatgtggtcatcaccatcgccaacaatgatgtcgatctgatcatcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccactttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcattctcgttcctggggaacccccactctgacctgttattaaagttcacattttgaatgcc

SEQ ID NO: 14668 - DNA, 825 bp, Homo sapiens
acaactcccaggacccagcgggcgctgccgcccacgcgacgtcacggcggcggagggcgcaggcggctgggcgcctggcgagtggactgttcgagcccttccgctgggacccgggccctggctccggccccgcgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccggcaccctgaggcctccagcaccagttccgtcattctcgttcctggggaacccccactctgacctgttattaaagttcacattttgaatgcc

SEQ ID NO: 14669 - DNA, 737 bp, Homo sapiens
taggctagtcgaggcctggtggtgctgggcccggctcggccccgtgatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaagccctcagtccgcctaacgcccaccatgatgctctacgctggccgctctcaggacggcagccaccttctgaaaagtgctcggtacctgcagcaagaacttccagtgaggattgctcaccgcatcaagggcttccgctgccttcctttcatcattggctgcaaccccaccatactgcacgtgcatgagctatatatccgtgccttccagaagctgacagacttccctccggcaccctgaggcctccagcaccagttccgtcattctcgttcctggggaacccccactctgacctgttattaaagttcacattttgaatgcc

SEQ ID NO: 14670 - DNA, 488 bp, Homo sapiens
ctcaaccatggcactattgacatttccagccagataattctttgtcataggggctgccccgtgcacgttaggaagttcagcagcatccctggcgccagcagtactgcctagttgtgacaaacaaaaatgtctctgcacattgccatatgttacttaggggggcagaattgtttccagttgcaaaccactggtggaggggcccctgactgaaccctcgctcctatccgcagacgcctgtgtgagcacaagtatggcaatgcgccccgtgtccgcatcaatggccatgtggctgcccggttccccttcatccctatgccactggactacatcctgccggagctgctcaagaatgccatgaggtggggtggcttgatgtgctggcttgggggcggacaggaaccggggtgcttgtacctactggtctttcccctctgcatagagccacaatggagagtcacctagacactccctacaatgtcccagatgtg

SEQ ID NO: 14671 - DNA, 377 bp, Homo sapiens
gggtccgggagcaagggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcggtaagtggggcgaccccagcctactcagtccgcggaggccccgcggcgcacgtccgcagcctccatcacagcgcgggcgcgcagacggggctggcatctaccatatggggggcatccgggccgaaccaagtgacccgcgtggggggtcccgctggggactccgtgccgcaccctcc

SEQ ID NO: 14672 - DNA, 1336 bp, Homo sapiens
taatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14673 - DNA, 616 bp, Homo sapiens
  misc_feature (31)..(31): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (47)..(48): n is a, c, g, or t
  misc_feature (51)..(51): n is a, c, g, or t
  misc_feature (53)..(53): n is a, c, g, or t
  misc_feature (56)..(56): n is a, c, g, or t
  misc_feature (65)..(65): n is a, c, g, or t
ggaattcgcgccgggggagagagtgagcgtnatgcacantntnagannttnanagntggagatgnaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14674 - DNA, 2302 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14675 - DNA, 2558 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtttacaaaaaaaaaaaaacaaaacacttgtgcagacggcactaggacctcgaaaaagctcttaaaacccatcggtaggcacgcgcgggccccagaaggtacggtgaaacgaggggctaaaccggtcccaagagagaaccgggccagaataaggaggattctccccataaaaaccgcgggggaaacagacggttggaacaaaccaaagagaatccgagacaaacggatccaacacaggagtccagcaccaataatacga

SEQ ID NO: 14676 - DNA, 2338 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgctaaatccattagagaccgggtggacgccaataaagaagacacagagagaagaagtctgctggtgttgtggaagaacgcaggggattctcagaggcaagtctatggggaaaggtattccctcagcccagaaatacaatttaccccttggtcccggtcagcaaactggggtgaatgtgaagaaactgaattgtccacctgtttgaccacggttcttacaagaag

SEQ ID NO: 14677 - DNA, 2126 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtaca

SEQ ID NO: 14678 - DNA, 2429 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14679 - DNA, 1485 bp, Homo sapiens
taatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttatttttgttgttgctggaagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14680 - DNA, 1401 bp, Homo sapiens
tgcaagaagtcaggttgactaggaaggagtctgcttctgctacttggagaagagatttagaattatgtatcttttgttacagatatacagatatacaaatatacagatatacaaataagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14681 - DNA, 1489 bp, Homo sapiens
  misc_feature (6)..(6): n is a, c, g, or t
caccgnctgagggcaacgagggccgattttttttttttcaaaaacctcatttattatggagatttacatgccaacagtacaattaacttctataaaccacattactgtttagaaaacacataagcaatgtcatatagagattgagagcacagtccttgaactgaatttgaatcccacctccgcttacccactgggcatcaagactgagccctttcctaccgcatggaattgttatgaggatcaaaggagacaactataaagctcctagcatagcgattccaattattttatattatttgatcttttgagtccaggagttttcgcataagccataatttccaattcttcaaatagtaggcattattagaacttttcaagccactttctctttggaataatattctgaaatgggaagcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14682 - DNA, 1188 bp, Homo sapiens
actagaaaacggcccgccagtgtggtggaattcttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14683 - DNA, 1038 bp, Homo sapiens
acaagatgcaattttaaaacgctgatttctataccatgtgttatctgtctccagtgatactgagtagtctcattcagaggctccctaaggcggggggagaaaaagacacataatgaatgttacattaccttgttttaaaaacagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14684 - DNA, 1743 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcaggtttacaagttttcttctcatctattcagtagatattttgtcgagtacctgtgctaggttcagctgtgcccccaaaacatgtacattcctaacttttattacctgtgaatgtgatctcatttgcaaatagggtctttgtacatgtaactgagttaagatgaggtcatactggattagggcagaccctaatccaatgaccgatgtccttatatgaagagggaaattagacacagagacacacagaggaaagacagctatgtgaagatggtatcagagaatagagtgatactgccacaagtcaaaggatgtcaagaattgctggcaaccaccaaatgctagaagagtccagaaaggattttctcttagagcctttgaaggaagtatggccctgttcttcttgattttggacttgtatcctccagaactgtgagataataaactcctgttgttttaggccactcagtttatg

SEQ ID NO: 14685 - DNA, 1091 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccattacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcaggtttacaagttttcttctcatctattcagtagatattttgtcgagtacctgtgctaggttcagctgtgcccccaaaacatgtacattcctaacttttattacctgtgaatgtgatctcatttgcaaatagggtctttgtacatgtaactgagttaagatgaggtcatactggattagggcagaccctaatccaatgaccgatgtccttatatgaagagggaaattagacacagagacacacagaggaaagacagctatgtgaagatggtatcagagaatagagtgatactgccacaagtcaaaggatgtcaagaattgctggcaaccaccaaatgctagaagagtccagaaaggattttctcttagagcctttgaaggaagtatggccctgttcttcttgattttggacttgtatcctccagaactgtgagataataaactcctgttgttttaggccactcagtttatg

SEQ ID NO: 14686 - DNA, 189 bp, Homo sapiens
gagggcagcctaaaggagaaacaactggcaattatcccgggtaatatgatcttggctgccttgatggtaattaccgcggcggtaagtctccctgctgtctggactgaagaaaattttacatactggcttctgttccatttcctcctttaattaggccagttacttggatggattcccctattgaagttt

SEQ ID NO: 14687 - DNA, 2364 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttaggcaagttatttaatgtctctgcatttttgacatgcttgtaataatgctaatttatttcacagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14688 - DNA, 1253 bp, Homo sapiens
aagcatggtatcaacccagagtgcccattacaggatcctgggaagcagagtgtctggatggaacctgagctgggtctctgactcacttctgactttagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14689 - DNA, 2429 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14690 - DNA, 1697 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccattacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcaggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14691 - DNA, 2375 bp, Homo sapiens
aagctgagcgtctcagagaaacaacagaagacggagaagacccgccaggctacaccaccgacatgagaacagataaagaagctgactcaaatggcagagggcagcctaaaggagaaacaactggcaattatcccgggtaatatgatcttggctgccttgatggtaattaccgcggcgtaaatcaacaggattacctttcccttaataatcttcaaaatgtccacgtgaaagacaggaagatgtttaatgggaagaccaaacatcgtcagtgctcaagtccagtagataacaaagaacagaaagaaaacaaaactttggtattttactggaatctgagtgaataaatagggaccacaggacaaatggcaaacaactgcttgagttacatcagaaggaaagaagaaatgatgaacccagatttccagtaagaaactgttacacaatatgattaatggagctaacaagtgcctattacacattagaaaatcttctagaggattttaaaacaaaaggaacaacttgtccagagtataatcgatgcttccagttaaatttcacaattttgcacctcagggaatacttttgtttttcttagagagcaaataaactgaccatttcaccttggcaattattaacctgccttgttttttataactaggaaaaatttggcttatctccatattttagttgagatgacatattaattcatatttttgtgggtaaaatgttattacccttaatacaaagcaaagtttcagctggacttcgtttttacttaatcttcaatggaacattactgaagttacagtacaaaaattctctgaatgaacataataataagttgtaaaatatatatatctttataaagatatattattggatctttcacaaaaagtcatacaagtggggaaaaaagaaaaatatcagagtattgggatttgtccttgaatcttctcttttagctttctttcagttaaacctgtgtccacatgtttgtttctggattgaagccagaatcaacattgtccctatttctaatcaaataatggagaaataattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcgttgatcttggaagcaagaggcagtatgcagattgttcagagattttcaatgatgggtataagctcagtggattttacgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 14692 - DNA, 4169 bp, Homo sapiens
cggggtcagatacctgggggtggggaggggccacagaagacattgccagaccacgctgtcccggcagctttccctgcaactgacagtacctcagagggaaagagtgtgcgtcatcctaaaccatctacctcagaaagcaagcagagcactccctcagagacccaaacagtgggggcacatgtactgcaggtgtgcagtgagcacacatcacattccgcccatccagagcctgctctgaatttgactttggcatcgaaggaaatcccaagtaaactggaagcacaattaggtcagggaaagggagaggccaagctggatctgaaatatgttcctcccaggagagttgaacaggagggaaaggcagcccaggaagggtatctgggatgccacaaggaagagaatctgtcagccttggagggaagggatccatgtggggaagcacacccggaagccaccgatgcacttggccatctgctgaacagtgacctccaccaccttggggtgggaagaggcaactgtgaagagaagagaggagtcaacccaggggagcaggattctctccacaccacccccaaacagggctctgcttccttaggaggggctgataatcagcccactggcaaaatttcaccatgtgcaggtgagaagttgggtgaaaggacatccagcagcttttcaccaggtgacagtcatgtggcttttattcctaataatctgactgacagcaagcccttggatgtcattgaggaggaaaggcggttgggcagtgggaataaggacagtgttatggttttggtgttcaatccttctgttggagagaacaagacggaggtgcctgagcccctggaccctcaaagtggccgctcagaagcacgggaaagcaaagaggtcaccacatctgttgctgaaaacaggaaccttctagagaatgcagataagattgaaagcacctcagcaagagcagattcagttctcaatattccagcacccctccacccagagacaactgtgaacatgacctaccagcctacaacacccagtagcagttttcaggatgttagcgtgttcggtatggatgcggggtcccccttggtagttccaccccctactgatagtgcacgcttgttgaacacgtcccccaaagtgcctgacaagaacacttgccccagtgggatccccaagcctgtcttcacacattccaaggacacaccttcctcgcaggagggaatggagaactatcaggttgaaaaaacagaggagaggacagaaactaagcccatcattatgcccaagcccaagcatgtgaggcccaagatcatcacctacatcaggaggaatccccaggccctgggccaggtggacgcctcgctggttccagtggggcttccatatgccccgcccacatgtaccatgcctcttccccacgaagagaaggcagcaggtggtgacctgaagccatctgccaacctctatgagaaattcaagccagacctgcagaagccaagggtcttcagttccggattgatggtgtctggaatcaagcccccgggacatcctttcagtcaaatgagtgaaaagtttttgcaggaggttacagaccaccctggaaaagaagagttttgttctcctccctatgctcattatgaagtccctccaactttctatcggtcagccatgctccttaagccccagctaggattgggtgcaatgtcccgtttaccatctgcaaagagcaggattctgattgcaagtcagaggtcttcagcgagcgccatccacccaccaggacccataacaacagccaccagtctctacagttccgatccttcagatttaaagaaagcttccagttcaaatgctgcaaaatccaatctcccgaaatctggtctccgtcctcccggatactcacgtctcccggcagccaaactggcggcatttggctttgtccggagctccagcgtctcctcagtctccagcacccagtccggggacagtgcacagccagagcagggccggccagccacccgttcaacctttgggaatgaagaacagccagttctgaaggcatctctgccttctaaggacacacccaagggggccggccgggtggcccctccagcatcctccagtgtgacagcaccccgcaggagtttacttccagcgccaaaatccacttccacacccgctggaacaaagaaagatgctccgaaagatcaagatacgaataaacctgctgtttcatctcctaagagagtagcagcttcaaccaccaagcttcattcaccaggatacccaaagcagaggactgcggcagctcgaaatgggtttccgcccaagccggacccgcaggcccgtgaggctgagcggcagctggtgctgcggctgaaggagcggtgtgagcagcagaccagacagctgggcgttgcgcaaggggagctgaagagggccatctgcggctttgatgccctcgccgtggccacgcagcatttctttagaaagaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaaggaaaaaaaaaaagatacagagaagaagcgcctttcaactcaccaccaagtggtactctctttaacacgaacaccagctatttgtgaacggtaactgcctttggaacaatcagcttctcagtcaacatgatgtgagatcacta

SEQ ID NO: 14693 - DNA, 1926 bp, Homo sapiens
gctgcctgctctcctcctcctctcattcctctgcctcctggattcctgaagtttaggagaaataaggtagccaagggaaccacatggaagttgtgacagctcccggcggcgcgcccctttcgtgtgtgccggtacctcggcttaggagttgcccgctgacaccttgaatgaaggaggtccccttgccagccagcctgccgggatgggccattgctgctgcaagccttataactgccttcagtgcctggacaagacgaatgaaagtgcccttgtgaaagaaaaagagctgtcaatcgaacttgcaaacatcagggatgaagttgccttccatacagcaaagtgcgagaaactacaaaaggagaaggaggagctggagaggcggttcgaggacgaggtgaagaggctgggctggcagcagcaggccgagctccaggagctggaggagcggctgcagctgcaattcgaggcggaaatggcgcgcctgcaggaggagcacggtgaccagctgctgagcatccggtgtcaacaccaggagcaggtggaagatctcaccgccagccatgatgctgctctcctagagatggaaaataaccacacagttgccatcacaatcctgcaggatgaccacgaccacaaagtccaagaattgatgtccactcatgagcttgaaaagaaagaattggaagaaaattttgaaaaactgcggctgtcattgcaggaccaggtggacacgctgaccttccagagccagtctctgcgggacagagcccgccgcttcgaagaggccttgaggaagaacacagaggagcagctggagattgcattggctccttatcagcacttggaagaagacatgaagagtctgaagcaggtattagaaatgaagaatcagcaaatacacgagcaagaaaagaagattcttgagctggaaaagctggcagaaaagaacattatcctagaagaaaagatccaggttctccaacagcagaacgaagacctcaaagcaaggattgaccaaaacacagttgtcaccagacagctgtcggaggaaaatgctaacctccaggaatatgttgagaaggaaacccaggagaagaagagattgagccgaaccaatgaagagctgctttggaagctccaaactggggacccgaccagtccgattaaactctcgcccacatctcccgtttaccgcggctcctcctcggggccctcctctccggccagagtcagcacaacacccagatgacgccactacacggcctgcgggagctccggcttctcgtcctccggtctccaccctgagggagcaccgacccggtgccgccggagctggccctgtgcgcatgctcagtagctgcgaatgcatcctaggcgcgtcctcctctgatccccgtgtaagactgccctggtgtcggcacttaggaatgtgtaaatggtaaagtctgatgtgcaaacgttttaccatagttagagccaaaagaaagacacttgcaattgttcttgagcaatgaactttcactgcagaatttcaggttagttacaaaaagctcagttttcaatatacattgaataatcattgtgtactgcaccgatatgtgtgtatatttagatatacgtatatacacatgctgcggttctgaatttcattttttataacatgaagtgctgacatattttagtgaaggtcagcagttttctaacttgtgcctaagaattattgggaaatgaaaatgcatttctatctagcttcccaggaatatttctacccaaaatagaaaaaggaaaaaaaaaaagatacagagaagaagcgcctttcaactcaccaccaagtggtactctctttaacacgaacaccagctatttgtgaacggtaactgcctttggaacaatcagcttctcagtcaacatgatgtgagatcacta

SEQ ID NO: 14694 - DNA, 569 bp, Homo sapiens
tacagttttccctgttaacatcttgcgtttgttacaattgatgaaccaacactggtttcactctgcagaaattcccttttaaaaacatcctgtgtattagtttcctgggctaacagagtactacgacctgtgtgggtaaaacaaccgaaatataatctcccagttctggaggccagaacgtccaaggggaaggcgtcggcagagctatgctctctgaaggccccaggggagagcctcttcctgccttctgcgtggcttcgggtactgccatagcccttggccctcccgggttcggagaccgtcgctgcactgtctgccactgtcttcccgtggcgtgtgtctgtgtgtcctcttcccttgttataaggatgctggtcattgggatttagggctcaccctaatttcgttgtgacttcagtgtaattcgattatctctgcaacccaccccatttccaaacaaggccacagtcgcaggtacggagccagggcttcagcatgtcttctcttctcggggacacagtgcagccaggacgcccgtcttgctctggtcattttggaatttatcctag

SEQ ID NO: 14695 - DNA, 389 bp, Homo sapiens
acaattcatttaacctctcaggacttaaccgttcttatcggtaaaacagggatagtgatgcctgcccagaaaattaacatgaaccacaaataagaatatatgtacacactttgtaaaactatcaagtactatataaatcaaaagttaaaatggttttgtttagcactaatctgtggtgtagattttgtgctgcagaagtcacggtaaataagaattctgactgggagagttcattaggaggtggatattgggaaaagaaatggtgaatagttagggagtaaagcaatagttatcaacgccaaataatctgtacaacaaacccccatgacacaagtttaccatataacaaacatggacatttactgcattggattgaatttttttaacct

SEQ ID NO: 14696 - DNA, 179 bp, Homo sapiens
gaaatgcaaagtcaagggccccattcaagacctactgaatcaaaaactaagagtggagcccattaatctctgttttaagaagccatccaggagattctgatacaagctaaagtttgagtcactattttagagcatacagtagatttttaattgcattgttcaaaatcctttactctttc

SEQ ID NO: 14697 - DNA, 531 bp, Homo sapiens
aaaaatgttgcctttattcagtattagtgcattatcagggattccagatctcagttaaaatgagagaatctgaatctctaggcaatgatgagtgtttctgaaattcagattcaccagaaagaaattgaaagcaaagagaagacagtgttgtcaaattatcatataattcagctaaaaaaaaaatcatggtacttaagtgggagctagagcacatcactgcctttaagaagatatttaggggaataaaagaggtctgggacctcggaggtgaaactgagagaaagacaaagggacttcaaatcaagcatttgaaagagccaatgaggggccagatgtggtgactcactcctgtaatcccagcactttaagacgccaaggcgggatcccatctcaaaaaaaaaaaaaaaaaaaaaaaaaggctgggcatgttagtcccagctgtttgggagggtgaggcaggaggatcacttgagcccagaaggctgagtcagcagtgagccatgattgcaccactgtactctagcctacgtg

SEQ ID NO: 14698 - DNA, 275 bp, Homo sapiens
cccatggtaacaagctgaactacattcaacgctcagtgttttatgtaaaagccaatgagtgcccatataacccacaagaagacaccagatatgatctgcctctagactggatgctgaggcggtttgcagcagcaagcgaggatgagggtgccctggagcagaggcaggggagcagcaaagccaggaccatgccctcaagtcaccccagactgagcaatctccgccatggggcgcaggcataccctgggaatcccacgtggagagttgctcctgac

SEQ ID NO: 14699 - DNA, 1209 bp, Homo sapiens
gacggtcccactgtggggtgtgaagtgtccgtagagctgtgagagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgctt

SEQ ID NO: 14700 - DNA, 808 bp, Homo sapiens
cccctgctcatcactcccaataaaccagcttcctatttcgcaaagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgctt

SEQ ID NO: 14701 - DNA, 226 bp, Homo sapiens
tgaatatttattttataactagtgttctttctaaaaattttgttatctcttatagtttttcaattgatacttttttttaagagaaatcattttattgaatttttgctgcacaggacttcatgttttccatttggcttgattcctgcttccagcattttctcgttgagatttattccttaagtcttagtgttctcattgttggcaaactttgcttattatgcatcaa

SEQ ID NO: 14702 - DNA, 112 bp, Homo sapiens
gtaactaattgttattcatttaatgaattgatcaaaacttgatatttttgtacaaagaacatttatcgttcagtatcttctttcctgcatgcttttcagcaaatgagataaa

SEQ ID NO: 14703 - DNA, 678 bp, Homo sapiens
tcatccccaggctggtagctccctgcagagaggggccatgtctgatccacctctgttcccagaatcacgtgctcactccctgacctctttcacctccttttcaaacatcaccttctctgggaggacttccctgcttgcctccttaaaatcacaggccccaggtccctgtgttttgctgtgttttcccctatacttagcaactagaaagggagaggaaagtatgtttgctagagatgaaagttcaaggagccaacctaactgagtggagggagtgactcacattctccatgaaggaggtgggagcaggggcaccctctgagagcccagcttgtccccagagggaagctggtgtggacactttgtaatccacagtgttgtttacttattgattgctctggtgtctgtcgccccttctggaatttgagctccaggtgtgggggagacagtttgatgtggtcactgcttcctgagacagtgggtgcactactagaatagtgcagacctcagactccaagcccagcgcctgcgtccacttcctgctgtgtgaccttgaggaaattgcttcaccactctaagcctcatttttctactctgtacaatggggatgatggtactatctactttattgagttgtaatgaaaattaaataagcccttggaacagtgcctggcacacagt

SEQ ID NO: 14704 - DNA, 448 bp, Homo sapiens
attcagctcgtacccaataggaagtttggacttactttccaaagccctgctcaggtattagcataatatttaatatttcacgtgctgacatcattgatgtccttcttcatccattgaaggaaagtaatttgcagaagttataaaatctcagattgtacaaggaaaatttcaagaatgtttttggaatattctccaaaagtggtttagtgggaaactgagagcagatgaggggagatccccttcccaccaatcctgacagaccacagtgacgagggcggccctgaccccttccacgaggagctgtggcaaacagaagtcagagaaactgacactttgatgagtagatgaatctgtgtccctattttcagtctaaaaaaagaaatagcttggtgtgatggctcaagctggtagtctggaggattgcttaagcccaggagtttaagataaa

SEQ ID NO: 14705 - DNA, 393 bp, Homo sapiens
tgtaaattcctactgagaagccaccatcacacacctgtctgtgctctgattgggcatactgtgagcagtagatatgaaattgctgactgtggggtaggacaaattatatgtgaagattctaacatctcagacatcttattttctaaaaacagaaaacggacactgctaacctagctcatttttcttacaaaacaaaagcaagaactaagaagatctctcatagtaaataaaacatgcctggataaaataaataataagccttctggatttattagtcaaactcctaaaaacatggctgatgtttaagaccttccataattgggcagaaaaagtacactttcttctcctcacacacactctccccacaagtcatactaagtagcttcgctcttt

SEQ ID NO: 14706 - DNA, 426 bp, Homo sapiens
gggggccagagcttgagcttctaaggtgctcctgctctcgctgacagcctcagagggcctggggcagagaggccccctctgcttctcctgggctttctccctgagcttcttgcaacacctccctgtgagcacacagcttcctggtggggccccttctgcttccgctctaggggaggctctgtggcttgggtctgggggccaccgttggggatgcggatggccaggagtggggctgctgagcgcctgggctagtgacagcctgcctccacccactcccagaagccctgctggaatcccccacctcttccgaggctaggagcatctgcctctcctcaaacttcatacagtccccacccttggcccattgttcctgtcaccaaataaccttctcccccttccttgccagtcatttgaggttctgatagg

SEQ ID NO: 14707 - DNA, 351 bp, Homo sapiens
tccctacgtgtcgtgggaggaacccagtaagaggtaattgaatcatgggggcagttacccccatgttgctgttctcgtgatagtttccatgagatctgatggttttataaggggcttttccctcttttgcctggcacttctctatcctgccatcatgtgaagagggatgtgtttgcttcccctctgccatgattgtaagtttcctgaggcttccccagccatgcataactgtatgtcaactaaacctctttcctttataaattatcaagtcttgggcagtcctttatgtatagttctcactttacagaagtgagaacagactaatacagtaggttacagggcatagggtaa

SEQ ID NO: 14708 - DNA, 955 bp, Homo sapiens
  misc_feature (48)..(48): n is a, c, g, or t
  misc_feature (52)..(52): n is a, c, g, or t
  misc_feature (54)..(54): n is a, c, g, or t
cgtacgagaatcgctgtcctctccttgctcgagatccattgtgctctnaganangaaataaaggaggcacttcttgctcttgggtctctggaatcctggataactgcaggagaacatgcaaaagagggagaatgccctcccgataagaacccatgcaaagagctgtgccagggcgatgaattgtgtccggctgaacagaagtgctgcaccacaggctgtggtcggatctgccgagacattcctaaggggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctggcagagtttggtggtgaatgtcccgctgacccccttccgtgtgaggagctgtgtgatggggatgcatcctgtccccaggggcataaatgctgcagcaccggctgtggccgcacctgcctcggagacattgagggagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctgacctcttgt

SEQ ID NO: 14709 - DNA, 794 bp, Homo sapiens
cgtccgcccggaagcgcgacgctggagctgcggggttaccatgggaaccgaaccgccgcgcctcgcccaggacagttacacttagaggccttcaaaagagggagaatgccctcccgataagaacccatgcaaagagctgtgccagggcgatgaattgtgtccggctgaacagaagtgctgcaccacaggctgtggtcggatctgccgagacattcctaaggggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctggggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctgacctcttgt

SEQ ID NO: 14710 - DNA, 323 bp, Homo sapiens
gcacttcttgctcttgggtctctggaatcctggataactgcaggagaacatggtgagctatcatttgggatccctggccaacagtaacagaaagtgactagaggagaggagaactcatcccctgccttctcccagagcaaggttgcttgtaagtggagatgatcatctctataggacaggactggatgaatagattctcaggatggcctgggtcattcttcctggctttctttaccctctctggacaaggagataggacttccagttgggcttactagaggttctagcttttccctagaactcattaaatgagaacaggatca

SEQ ID NO: 14711 - DNA, 943 bp, Homo sapiens
cgtccgcccggaagcgcgacgctggagctgcggggttaccatgggaaccgaaccgccgcgcctcgcccaggacagttacacttagaggccttcaaaagagggagaatgccctcccgataagaacccatgcaaagagctgtgccagggcgatgaattgtgtccggctgaacagaagtgctgcaccacaggctgtggtcggatctgccgagacattcctaagggtatgttggcatgaggggcaaaatctgggcatactctctgacattgcctctgggatagatggaagtagagagcttcccaccttctaggttgcctctggaagtctcccttgcctagagtacttcttctttactcttttagggtccctcctcctttaattattcagtgcccccagttgtttgccttccatcaggaaagagcgcaccattgattatctatgtcttttactttggactcaaagttcctgtgaaggctggagggaagagttgtaaagggaaggctgtgtaagataatgattaagagagtagaccctagagccaagcagacctttttaagccttaagccttagctctttataaatcttaagcttttagcctcagtttcctcatctataaaatggggataattgtgaggatcaaataagatgttcatggcacaaggtaaacgtcagtaaatgttacagtaaatatttgctattactattgttgttattattgtctctttgtcttagcaccagggttgagaggcttaaataaatctcaggacttcctttttctgtttttcccttctgctgtgcccgtgggtgttgccaggcactattttctctctctctctctcttttttttttgagacggagtttcgctcttgttgctcagactagaatgcagtggcgtgatctcggctcaccgcaacctctgcctcccgggttcaagtgattctcctg

SEQ ID NO: 14712 - DNA, 782 bp, Homo sapiens
cgtccgcccggaagcgcgacgctggagctgcggggttaccatgggaaccgaaccgccgcgcctcgcccaggacagttacacttagaggccttcaaaagagggagaatgccctcccgataagaacccatgcaaagagctgtgccagggcgatgaattgtgtccggctgaacagaagtgctgcaccacaggctgtggtcggatctgccgagacattcctaaggcagagtttggtggtgaatgtcccgctgacccccttccgtgtgaggagctgtgtgatggggatgcatcctgtccccaggggcataaatgctgcagcaccggctgtggccgcacctgcctcggagacattgagggagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctgacctcttgt

SEQ ID NO: 14713 - DNA, 436 bp, Homo sapiens
ggcctaacagactggctacaatggaagttccaggaaagcagagattttgcctcttttctgcaaatgtatctcttgcgcttagagaagttgatagcacatggcaggttctcttgttgaatgaatgaattggagaataaaacccgtaacctaggtgacagtctgtcagctcagagtcaagaatccttgggttcactcacctgtcactacaaatggcatttgttagttattataagaataaatacttaaagaaaacctattcaagagaaagcagattcataaacttccaccatggatttcataagtaggtatatacatgcttatatgcatatgatcccacctagaaagctgctatcatatcatttcatttcattcctttttttttcaacaaatatttattgtagaggtatctctgtctttcaagccaaaaatcaggggg

SEQ ID NO: 14714 - DNA, 198 bp, Homo sapiens
gctacttagcactggatagattttttttttaatctgagtttctgtgtatgtaaacaggggaagtaatattaaacctggttgctattgtgatcatgggaagtaatagaagtatgtttctgagtatgtagtagtgtttcctgtgccaacagaagctatcacacaactgtgtaaacctatcattaaacattgatctgaaaa

SEQ ID NO: 14715 - DNA, 404 bp, Homo sapiens
ctagacttctcagggacccagactccttcagcctttttgcttggctagccgtccttagcaggtggcttgcacctcatgatctagtgtggcggcagccacatatcggctttctaaccagtaggaaggagaaaagggagatgaaggtcaggtcatacccttccctgttaaggacacttccctaagtcacacctgaaaattggcatacatgccattggccagaatttagtcacatttaatataatccttgctaaaaattaggggttttattactaaagaagaagaggaaaatagtcttggagaaaactagaagcttctgccgtactagtaataaaattttaagatacaataaatatttaatgtagatgttcaatttgttctttaaaatgtgatatttaaaaaccagc

SEQ ID NO: 14716 - DNA, 429 bp, Homo sapiens
aatccagccatcccacataatctgtgagatgatagactattgaaatcaagttatacagatgggacctatttcaatccatgctcatgtggctacttacttaatcagtttctttcagggatttgaaatctagggaagatttttgctgtatttgggaaaaatattgagggaactgtagaaattgatatcaaaaactgagggaggaggacttactaaagatagcagagctgaaatactccacaattgagactgagccgagttcttggcctgcaggccttaaagagttacaagttttcttcagtcttttgagtagaatttaaggtagacatgtggaaaattaggaggaaggatattagaccaagatatttttaatgttttgatgaaaaaagcaggagtgtagtatggtgaataatgggataattgcagagatta

SEQ ID NO: 14717 - DNA, 333 bp, Homo sapiens
gctatttgtggaagtagagaattgaaggcaacctaggtatttgtcactaagggaatgaacagtaaaatgtgataattacatcctgtggaaggaatactgtgcatcatttagaaacacatatttacatgtaaagatgtagttagagcaacatgggtagaactagaaaacagtgtttatatttaaaaagtaaaatatatggatctatagcataaaacatatgcttgtaataacaatatatattttaccagtaaatgtgtatatctgaggatatatcacattttagtatgaacttatgaaatggaggagaatgagaaagggattgggaatgagcaa

SEQ ID NO: 14718 - DNA, 347 bp, Homo sapiens
taatcctcaaaactgccacgtgaagtaggtgctcttgtttcccccattgcacaggtgagtcatcagaggtgcattctagggtcaatcagaggggtgagacaacagcaacgataaaccaattcatcttcaattaaggacaccatggacaaaaatatgacagactgggaaaagacattggcaatgtctttgactaccaagggattgtatttaggtaatatcaagaacatcagccaacaaagagccaagaaataacccaaatagaaaagagacaaagtgcatgaaataaaagaagaaattcaaaatgttcactaaaaaataaagagatgctcaaatccacaaaaaaaaaa

SEQ ID NO: 14719 - DNA, 187 bp, Homo sapiens
gctactcaggaggctgaggcacaagagttccttgaacctaggagatggaggttacagtgagcctagatcaccccactccactctagcctgagcaacagagagaagctgcgtctaaaaaaagataaaattccaatgttgggaccataaacatttcaatcactgtatttatttttattttcatttttat

SEQ ID NO: 14720 - DNA, 362 bp, Homo sapiens
cttaaaaattctgatacaaaattaatagtgcttaaatactacaacataaagtcaaaatatatcatgttgcatgataaagaaatgagagaaaagaaaacaaagatttttatatacatacatacaatgtatacataacaaaataaggagcaaatactcatggcaattacaattctgaaattgaccacatagccatagctggtatttatgactaccatcttccatcacccattctgtattccttttaccttcagcaagcacctcagctggtttacttggtggggttacccaaactttctgaactgggttgttgtagttttccactgaccttaatcactggatatggtaacattaaagacactgta

SEQ ID NO: 14721 - DNA, 388 bp, Homo sapiens
ttccaattttacagacctggtttatcagcaacatttataaaactagacctcaggaaagaactagttctggggatatatgcatggtcttaataaagtgaatggttagcctgtcctgactattacaaaatcaaaacagtgagaatatctgcagaatctatttgactctaaatgactttaagtactccctatcaagtaacgtatctttaacatctcaaacaaatcttcatttctatttttgtactctgcactctaaatctaaaagtttaatacttcttctctagagatatacatgtaagcttccatgttagtacccaaacagcctacctggcaaaagagccttagattaaaaaatgcactgttactgtaggcctaaattgatcaagtgaac

SEQ ID NO: 14722 - DNA, 182 bp, Homo sapiens
ttcctatggttcttactgtctcagggtctccttaaatatcaaaatgagtttgtaaagtctagtgttaccttatttgaacttcagggcaaatgactaaaagggacaaacctagaatagcaggttttaatcagttagcatattttccactgtaggtatcagaagactcaactacaaggagattc

SEQ ID NO: 14723 - DNA, 526 bp, Homo sapiens
taggaagattgcttgagccccagagattgaggctgcagtgagccgtgattgtgccactgcattccatcctgggcaacagagcaagaccttgtcttaaaaaaataaaaataaaaaaataaaaataaaaatctttttctttctgtttttaaaacttccattattttgagattcacaggctgcagcttattaagggaagaatttgataaaaagaaactgccaaacctctagagattgaatacatcttttactgtgtgaaatttattctaaagtattttatgttttgcccatcacttaaaaataaagaaaaaaattgaggcctagggtttttgaaatctggcaaatataaaggctaataatatagctactttgaaaatggaagtacagaacttccaaaagttaggcaatattgagaagcaaaggagactaagacaagttcagataatgatgcaataaatggtcaggagttcggtgtacaagagggaagggatgacacagagagagcctcttgctctcggctgcagactgt

SEQ ID NO: 14724 - DNA, 418 bp, Homo sapiens
ggtaagtcctcaaagagccattctgttcccatcctccccacttccccagtcttaggttggtttgatttttttcctccttgtaagatgtggtgagagtggaaagtaattcctccctggccttaagtcacctctgtgtactcaatcctgctgactggctcactggcatgatggcagcggctggtgctagggaggcctgggctggattgagccagcctggccctggtgactaagccatgagttttccagctctgggaatggtagctcttctcacgagaggggcagaagtagtagctgtttgtgcttggtggcagagaggactgctggacatacaccctccagactccaagatagaagggggaagacataagcccccagtatttgtggtgattgtaagaataaaatgctaatattacaaggg

SEQ ID NO: 14725 - DNA, 712 bp, Homo sapiens
aagcttgtgggcattcctggctagagattaatttggcactatttcaaactaatattcttgaaaattttaaagtatctgtcattaattgagcactacttgtgccaggctgtgttctgtgtactattatacgtaatatactattatatgtaacttactactatatcataacattctattatttgtactattatatgtactgttctatgtactgcatgagtacatttaaccttctcaacatttctattcataatgtacagttattttcagataaggaaataaaagcaatgagaagttaaattgtccagcaccctccctccctccctatgtggtcatgtgacccccagagattcccaactcaggcactcttagttctgctactctagtgaagggcagggaacgagtctcctgggaggtagttctaatgcctgtgctcctgggaacctaactgaagccctgccactgctcatttgtctcccctttctaaaatcatctattactccagcctgctttttttttcttagtgggtgaacagggtttctctaccaatttcccccaggggcttgttacatattccttttattatacttactattctctgaggtgacttctggtaaattcaactttcttcattccctaatattgccagtgaagctttcacaaaccgtatagtatagtattctgtgctgggttaaaaagctgccccccccccaaa

SEQ ID NO: 14726 - DNA, 487 bp, Homo sapiens
acagcttttaaaatcttgttctttcttctcggcgttgcatttaacattttcccctcagggataacgtgtcaccacagcatacagttctggtgtgactgtttcctgtgcagcagccgtgtccttactgctcagatcacgtgcggtgcattcccagcacctcagagggctcctcattctccgtccactcagtgcgtccttctcccggggaagccgctgtcactcagtgcatccttctcccggggaagccgctgtgcagacttccagctccacagctttgtttttggcattacatttacagcattttccttctacagcaaaacaccttttaatattccattttatgaccagcctggccaacatggtgaaaccccgtctctactaaaaatacaaaaattagccaggcatggtggtacatgcctataatcccagctactcaggaggtgaggcaggagaatcacttgaacccgggaggcagaaattgcaatga

SEQ ID NO: 14727 - DNA, 1277 bp, Homo sapiens
cagtgagtcaagggtgttgattggttgggtcggagatgaaatcataaggaattgaggtgtccttttgtgctaagtcagttccagggtgggggccacgagatcagatgagccagttaatcgatctgggtggtgccagctgatccgtcgagtgcaggtctgcaaaatatctcgagcaccgacataggagcagtttagggagggtcagaatcttgtagcttccagctacatgactcctgaaccataatttctaatcttgaggctaatttgttagtcctacaaaggaaatctagtccccagacaagaagggggtttgtcttgggaaagggctgttatcatctttgttttaaactataaactaaactaagtttctcccaaagttagttgagcctacacccaggaatgaacaaggacagcttggaggttagaagcaagatggagttggttaggtcagatctctttccccacctcagttacaattttgcaaaggcggtttcagaatcagagcacgaagtgttcctataaaaggaaaaaaaaaaaaaacctttcttaattatgctcatagttgtgtattgtcctgtcagcttgctcattgtgtaaaatgagcggacatgagaattcacgagcagagctttttacactgatatgtatgaaagcatcatttacgtcctgaaagccccagccgagcgatcactggcagtgccaacatttttgagtgtgggctccataggaagcactgttttccctattgagaattatagtgggtttttttcatttacgagtaatgtatacctagctccaagatcttggttgctaacaccattctccaataaaacgaaccagggatcgctggagaaatagctgattctaaaactagggcagaaagtatacaagatgagcctggagcatcttgtagagtcagagagcaaggcagaactttatacatacagtgatgtgagatgggcatgcagagggaagatgttcccagtggctgaagctgaaacagtgtgagcaacaaaataaagcagtgttggatcacaacccaaagaattgagtccaggcactgtggctcatgcctgtaatcctgcactttgggaggccaaggcgggtggatcacttgaggtcaggagttcgagaccagcctggccaacatggtgaaaccccgtctctactaaaaatacaaaaattagccaggcatggtggtacatgcctataatcccagctactcaggaggtgaggcaggagaatcacttgaacccgggaggcagaaattgcaatga

SEQ ID NO: 14728 - DNA, 445 bp, Homo sapiens
cagtgatgtgagatgggcatgcagagggaagatgttcccagtggctgaagctgaaacagtgtgagcaacaaaataaagcagtgttggatcacaacccaaagaataaaataaatatcctcgagcccacaccgatataaataaatgattgaatcaataaatgagtccaggcactgtggctcatgcctgtaatcctgcactttgggaggccaaggcgggtggatcacttgaggtcaggagttcgagaccagcctggccaacatggtgaaaccccgtctctactaaaaatacaaaaattagccaggcatggtggtacatgcctataatcccagctactcaggaggtgaggcaggagaatcacttgaacccgggaggcagaaattgcaatgagccaagattgcaggactgcactccagcctaggcgacagagtgagactccatctcaaaa

SEQ ID NO: 14729 - DNA, 755 bp, Homo sapiens
acttttgtagttaaaaaaaatttttactttaccagggcattgcaattcttttccatcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggtagagtatgtgttgggggcaggtttatactgcatgggtgtgctgagacagggccacgtggtgatgtaaatgatgctgcctgacacgtgcagctgtaagaggggtgaacggagtaccctctgcatgaaataaacttcctttgcagttatcactgacctagattaagcagcgacgcaggcctgttctgtactttgtttaacaatgcacagtttctttttcttttggagatttgtaaaggaagactcaaatgaatttttccctattcatggtgcctggctcatagcgggcgcttaacaaatgctcctctttgccttcccactccattttgttccaggggcgaggagggggtta

SEQ ID NO: 14730 - DNA, 769 bp, Homo sapiens
acttttgtagttaaaaaaaatttttactttaccagggcattgcaattcttttccatcagtgaatttcattctacagacttttcagagcatctcataatcagtcaacaaatctatttcaaatgtgtttgttactaagcaacggttgctaagagcttctgtaattaagatgaaagttccaaggtaacaatgcccaaacacagcaccattttcaccattttctgataatgcaggagtaggatggctaaaagtgaaagaagaatctactctatggaaagcatggcacctgaaatttctgaagatattggctgtcctctagcttatatgagagagagtgtttgtgctttactaatcaaccagtcatttttttcttgtgtggctgaaatgtacattccagacatgaacaggcctggtaaggcagaacggagagccgagaagggcctgaggcctcccaggaagctggttggggagaccagaaggctgcaaagctggccaacgcttgccaggtggctgcggagagtcagcttcagtctctacaagccgcccatccaggcagctcctgaaccagatccaggcaactgggccaagtccccaaggctgtctctgggaccagaaggtataaccaaagggaagcatggatttaaattccagggcataaaagaaaagttcaacgtatctaagaaggtgctgaaaatgacttttttgtaaatgtctgaaggacactgtcttataccataccatatacaataaaattttaaatgagcctgagttc

SEQ ID NO: 14731 - DNA, 476 bp, Homo sapiens
gactctgtctgttggaccaatttgatgcctgtgcacgctcagggctctctgaaccccgctccttgactctcagggtcccctcttgcggaaagcccctcccgggaccaggagccaggctgggcagggaggtgacaccctgcctctcttttgcatttgcttggtgctggctgaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgtacgtaagttggcccagtggagcccgctgaacttggcttcacagggcgtgaggaggtgctgggatgaagaaggggtctatacagagctcacacccccaacttatgaatctgatccccaaagt

SEQ ID NO: 14732 - DNA, 597 bp, Homo sapiens
ccttgtttatttgcatgcatcactttatgttatgcataatgtctagaaggcatgctgttttattgcctgtttgcatttttcacccaaattgctggaaactaatgaacattttaaaggagccattcctttagctgcagtcatttctctaaattgatatctttttttgggggggaggcagtgaaatcattttaaacattactttttgaaagaaaaaattattagacaaaagttaatattttaaaataaatcttgagaaactagagattaaataacttaatgaaacatatttcagagttgaattttggcagcaattgtaaataatatttataatctggtgatattaaaagtgaaaagttacaagggggagaaggaatgctctcctttgaaaattagtggccacatttggtgatggatgagatgaagatgcatccttccataatcttgcctttttaaaaaaattataaagctcaaatgcattttgccagaaaaattgcatgaatcttcagcatgcattgttaactttttgtcttttcccctttctttctgctgttcattttcattcatatatttttgatttttggtttgccattgtttttt

SEQ ID NO: 14733 - DNA, 313 bp, Homo sapiens
attctcagcagcgtcgaccaaatcgcccacactttgttgctcttggaaaggcagtgtcccaccctccaggggcctgatgcaactggcccccactctgagaccccccagttacccttataaccacatctaccactggagctccatagccttccagtcaaaacccaccaaccagccaggcacagtggctcatgcctgtaatcccaacactttgggaggccgaggcaggcacatcacttgaggtcaggagtgcgagaccagcctgacccaacatggtgaaaccctgttacttaaaaaaaaaaaaaaaaaagccggg

SEQ ID NO: 14734 - DNA, 387 bp, Homo sapiens
tcccattaaaaagttcttggcctgcttctctattaatatagagtcccatatgcattttacattgttgacttctaggttgtcaattatttagaagtatttttggaaaaacctaccttatctgatttcagtttattagcacctttagttacagaaacatgaactctaacatacactcaaactgatcattttaatattttatccagtagtggaaaaagggtttactggaaaaggatgtcccaattatctagattgaatgaggtagtttttctctgtgcattacagctagcaatatttatacgagtaaatgatagagttattgagagcagaagcaatgtggtatttccagaaatgaagtcttcaatggagtcagtttactggataaatgtt

SEQ ID NO: 14735 - DNA, 490 bp, Homo sapiens
tgtaaagatataaacacagtaaacactggcattactgcttagaacttaatcaatttggtaatggctattactttgtcaagttggtagacagcagggacaatgataagagaagagaagggggaaaaaagagaagagatgagagaagactgtgtaaggacataccccgactcatttggaaagaaaatatgaaagcaacatcggggacaggtctatatctgagaagtgtatgagatgcttaacattttttacaaatttatattcattatgcattactcattggatattctgactaagaatgatttgccaaggccaagtttacagtgaaacaatgttttttcacaggatatataatattttatgggcagcactgaattcagtctttctgggtagttagatgatatatatttcctagcaggaaagagttattaaatgagaatgatgaatcagttgtgcttcagaagtcccattgtaaaaattaccagtttaagtc

SEQ ID NO: 14736 - DNA, 1490 bp, Homo sapiens
agtgataaaatatcactctccctccctggggcattagaggagtcctcacccacccacctcctacacaagtatcttttagggacagtggctcaccattgtggactttttgagtgtccacctgatattacaagttgcattgaccagaacacagattttgctcttctgtgtcaatacccatttcttttctgaaggtcagaagttggttaagggtttgggggaccagctagacactcttcttagtcccatggagctgactggaagttccatgaggggaggaaattgatgtcaaagtgtcattttaaagcttaagctgaaagtttattttttaaattctcattcattcatttagcatatattgattgagcatctacaatgtgccagttgtagaattccatctcagaagagacttgacttgtggatggtggaggggcagtcctgctcggaagcagatgatgtgaaatgttcctttccagtctggttcacgatgtttaacagatttgtcaggtcaccactgtgaccccaagctttgctggcagattgttatatagtatttactgagagccctgctatctggtaaaggcagttaaaaagcctgcaatctcgactcatttccagcatgaacagactggtccttgctgctttacacaataatcaaagctaccttttatggcgtgctcgccactcccaagcactgggcgaagtgctttacccgtcttcccctccgcgatgcctcatgcccactttagcagatagtactgttagcattcccattttacagtggaggaagctgaggctcagagaggttaagcaacttagctgaaggccacaccaccagcgaagtgcctgagccaagatttggactcgagtcatgggacccccacgctcgtgagctgactgctctgttccactgggtcccttcatgaggtcgtcccacagcactgctagttccagggcgagtgccagcacatggccccactgggagccggggcctgacttaggtctactggaaaaagtgtcacctttggggacactcaaggacaggctggttggtttcgttgtggattttatatactcatgccctaaccctgtgttcctggtttctataaggccccggggaaggtgcaaggaatttgcaaatagggcctgtatgacttatttcctaggacacgggaagcttttcttacctcctttctaccctcttctccaacctgaactcccaagtttcttctcctgaaggtctttgcactataagcgccaaggagcccgtgtgcgtggcaggggcggctgggagggtatctggagaaccttagtgaggcctctggcctagccagagaggcaataagcttggggacgttccgttctgggttctgacgttgttggttctgacgtcgttgtgctcttttgtaagaggaatttcataccttggagacgctttgtacatatttgtaatgactttattaaaaaactgattgtgcacttctaaaaaaaaa

SEQ ID NO: 14737 - DNA, 685 bp, Homo sapiens
aaaggtacttgaggatcttgtaataaccagcgaagtgcctgagccaagatttggactcgagtcatgggacccccacgctcgtgagctgactgctctgttccactgggtcccttcatgaggtcgtcccacagcactgctagttccagggcgagtgccagcacatggccccactgggagccggggcctgacttaggtctactggaaaaagtgtcacctttggggacactcaaggacaggctggttggtttcgttgtggattttatatactcatgccctaaccctgtgttcctggtttctataaggccccggggaaggtgcaaggaatttgcaaatagggcctgtatgacttatttcctaggacacgggaagcttttcttacctcctttctaccctcttctccaacctgaactcccaagtttcttctcctgaaggtctttgcactataagcgccaaggagcccgtgtgcgtggcaggggcggctgggagggtatctggagaaccttagtgaggcctctggcctagccagagaggcaataagcttggggacgttccgttctgggttctgacgttgttggttctgacgtcgttgtgctcttttgtaagaggaatttcataccttggagacgctttgtacatatttgtaatgactttattaaaaaactgattgtgcacttctaaaaaaaaa

SEQ ID NO: 14738 - DNA, 836 bp, Homo sapiens
gatagaaaagtatataaacttatctccaaactacagttcataaatcctgattgaaaatggtacctactgtcctgcaaaacctcatccctataccatcatcccaggtctcactttctctgctaactgtagtctaactgctgagcttggcaacagaacaatcccatgagtctgtggccctcaaatgagctgtgttctctggtgatttttgcacagatgattccccctattgggataacatttctttggcttgtcagcttggtgaattcctattaagtcctcctaaattctgctccaggcgtttctcctccaacaaaattccctctttgcccagtgaatcccccgcttttttggagagctgctgtgcactttatattgttttgtgatatatgtataaaaaatcagtttcttgtttgaaagacaaaaagactaatttatttttgtatcccaacaaagtggcagacagtgcatgtgaaatgtttgttgactgaacatagctcttcattcctgtctctgttgtcacacttatcaccatccacttaatattaattattcatgtatgtatctgtctctcttgcatggttttaagcttccggatgtcagagaccatgcctaattcctctaaatattccctcaaagcactcctaatatgcattgtgggagttagtactcaataaatacttgctgattaggagaatacttagaacaggggtgtctgatcttttgacttccctgggccacattggaagaagaagaattgtcttgagccacacacaaaatacactaatactaatgatagctaataagcttaaaaaaatttttttaaaaaatcacaaaag

SEQ ID NO: 14739 - DNA, 446 bp, Homo sapiens
catgcagtcatgaggatcactttgaaactagacatagtgccaagtgcttttcagaaaagtgaagaattagattgagcagaggaaatttacctatttgtgagtgaggatgatggaaggagtcttggagaggtagtactttttaccttctctgatcagtttcagggcttctcctgagcctactgaatctaggagaattatttacagattacccaacctcacatttgaagctcttagttttattttgtcatactactactccacttacatcattaacttgcttgggagagagacaacccattagtggctctgtgtgtgtggtttttgtttttctttttaggtttttttttttttttttttgagatggggtctcactatattgcccaggctggactcaaactcttgagcttaagtgattcctcctacctcagcctcccaaagtgctggga

SEQ ID NO: 14740 - DNA, 2957 bp, Homo sapiens
gcggcagcggcggcagcagaagctcggctcagcggctgggggtggccgctcgaatctgccagggcacctcgctccctcgcctctggcagcgggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtcctatctcggtcactgatgtctccaaatacgccttctttgctgtgtgggcttccagatatcaacaaaatactccctctctgttcctgtcttagccagaggcgtcgctcctgtcttgcttacttgcttggtcacgtccgtcacagccatgttcaagctatccctgcctcttcttcgccctgttctgtgccagacgctaacacacttttctccctgtgtctgggtccaaacgtgcatcctcttggttggcccccttgtcagtcccagacgtccacttgctcttccttatgtccaatgtctgtcctcctcttcaggacatgctccatttattttccatggaagacacagggtcagagatctgtcagaggaaaatggtctccacagcaactctggagggaagctgaagacagatagcttcctcctggtgtcctggccgctggcgtgtctgccctgagatgctcgctctcctgctgggctagaacgggacgtcttctaaaaagccttgggcagggctagcaacatcgtaggtgtttattaggcttcaggatctttcccatgaacttgtgatatcattttgaaacccttcaatctggctttgttgctgccaaaggagataactgttggaagttcacactggggaaactcattttcccctgcagctcccccaaggtgcaggagggcaggatccagcagcactggggatgccgaggcaatgctgtacttgaagccagaggacccaaattgccgccctggctgtgctgcaaacaagctgtgagatcttgaatagtgttctttcatctctggaccccactttccacatctgtgcactcaagcttggactagaggacctttaagttttctttctgtttctaagacaacagtatgctgctatagccgtctgctacctcgagaagccatggcctgcctgccttttggctttgtttcaaaggaacgaccctcctcatttgggccttttagacccctgacctttccagctttgtccttcagattaatctggatgtcttttattcaaagctgagtcagtggctcttgcgaatgccccatagcagaagtcccgggaaggtaaatgccaaacccagagccatgtgagattctgactttgatcttggctgtggtttaatagcatctcaggattatttatcatattctctttttttcttattgcttataaggtgtcagttattgtttccattgttgtttactttagttctggaactgaaaccgacaggaagaaactttggaataaggaagagaagattgaccaaaccatccaaatgccaaaaag

SEQ ID NO: 14741 - DNA, 1858 bp, Homo sapiens
  misc_feature (1843)..(1843): n is a, c, g, or t
  misc_feature (1856)..(1857): n is a, c, g, or t
gctagaggacccggctcatgtcagttcttaagagtttactagattctcaaaagaatctgtgatttcctacccttaaaatgatttaaacatttttttaaaatcctcataggaacaaaatggccattttgggcaatatactattttaagcataagaatgtagctacctatcttcactaattactgtcctaatgcagatcataaaaataagccatgtttctggaaagaacataaataacaataaatggagcaaaaagaagcacccatatgttttaatcacaaagcgatcagtagggtgtaaataaaccttttgtgacactcggctgtaccatacgtcaatatgccacaagctttttgctttagtattgtttattaaatatttccacaaaacaagtcataataggaagcaatagttatttgagttttttaaaacaaggacttgtatttttcaatgctgctttcttttataacatctttttacttcccccattttaggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaaggtacaccgttctgcacaggggacatcatcaggaactcgagaaactgcccatacacaatgacccagaatccctggaatcatgcttctgattgaggacatggctcacaacttagccattcattcgcattcatgtttgcatgaacaggtcaccctggcatcacttctgaacctcatcaccaccagtgaggcatcaggtagtaggctgagagcccagaggaggtacatggnggacagtgttggnng

SEQ ID NO: 14742 - DNA, 1755 bp, Homo sapiens
gctagaggacccggctcatgtcagttcttaagagtttactagattctcaaaagaatctgtgatttcctacccttaaaatgatttaaacatttttttaaaatcctcataggaacaaaatggccattttgggcaatatactattttaagcataagaatgtagctacctatcttcactaattactgtcctaatgcagatcataaaaataagccatgtttctggaaagaacataaataacaataaatggagcaaaaagaagcacccatatgttttaatcacaaagcgatcagtagggtgtaaataaaccttttgtgacactcggctgtaccatacgtcaatatgccacaagctttttgctttagtattgtttattaaatatttccacaaaacaagtcataataggaagcaatagttatttgagttttttaaaacaaggacttgtatttttcaatgctgctttcttttataacatctttttacttcccccattttaggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaaggtgagtatactaagggagttcattgatttggttgatttgtattactcagaaggggtaatgctccagttttctgtttccaaaggggttatccctgaaacctgcatagagtttgcaaagattataaaagattctactatct

SEQ ID NO: 14743 - DNA, 1694 bp, Homo sapiens
gctagaggacccggctcatgtcagttcttaagagtttactagattctcaaaagaatctgtgatttcctacccttaaaatgatttaaacatttttttaaaatcctcataggaacaaaatggccattttgggcaatatactattttaagcataagaatgtagctacctatcttcactaattactgtcctaatgcagatcataaaaataagccatgtttctggaaagaacataaataacaataaatggagcaaaaagaagcacccatatgttttaatcacaaagcgatcagtagggtgtaaataaaccttttgtgacactcggctgtaccatacgtcaatatgccacaagctttttgctttagtattgtttattaaatatttccacaaaacaagtcataataggaagcaatagttatttgagttttttaaaacaaggacttgtatttttcaatgctgctttcttttataacatctttttacttcccccattttaggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagttctggaactgaaaccgacaggaagaaactttggaataaggaagagaagattgaccaaaccatccaaatgccaaaaag

SEQ ID NO: 14744 - DNA, 3357 bp, Homo sapiens
gctagaggacccggctcatgtcagttcttaagagtttactagattctcaaaagaatctgtgatttcctacccttaaaatgatttaaacatttttttaaaatcctcataggaacaaaatggccattttgggcaatatactattttaagcataagaatgtagctacctatcttcactaattactgtcctaatgcagatcataaaaataagccatgtttctggaaagaacataaataacaataaatggagcaaaaagaagcacccatatgttttaatcacaaagcgatcagtagggtgtaaataaaccttttgtgacactcggctgtaccatacgtcaatatgccacaagctttttgctttagtattgtttattaaatatttccacaaaacaagtcataataggaagcaatagttatttgagttttttaaaacaaggacttgtatttttcaatgctgctttcttttataacatctttttacttcccccattttaggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagggatgcagtggagtgtggtggccagtgggagagtcagtgtcacccgccagcaacttctcctttggtggctgctcagcccagtgacacttaggcccctgggacaatgacccagaagacagccatgcctccgaaagagggccaggtcctaagctgctgcttgtgcgcgactgcacccggtattctcttcacctgaggctttccgtccgccagtgcaggaacccggtgctcgctgggcttttcctctgagattccagcaggtggcgctggagggagtcaggggacataatggcctccttgttcactttttatttcccaacactccctcttcccagattctctgcttttgccgcgtggtctctggtgtctctgacatgttcccgtcactcactgtgtctgatctgtctcactcacgttctaagcacgatagcttgctgcgtcctatctcggtcactgatgtctccaaatacgccttctttgctgtgtgggcttccagatatcaacaaaatactccctctctgttcctgtcttagccagaggcgtcgctcctgtcttgcttacttgcttggtcacgtccgtcacagccatgttcaagctatccctgcctcttcttcgccctgttctgtgccagacgctaacacacttttctccctgtgtctgggtccaaacgtgcatcctcttggttggcccccttgtcagtcccagacgtccacttgctcttccttatgtccaatgtctgtcctcctcttcaggacatgctccatttattttccatggaagacacagggtcagagatctgtcagaggaaaatggtctccacagcaactctggagggaagctgaagacagatagcttcctcctggtgtcctggccgctggcgtgtctgccctgagatgctcgctctcctgctgggctagaacgggacgtcttctaaaaagccttgggcagggctagcaacatcgtaggtgtttattaggcttcaggatctttcccatgaacttgtgatatcattttgaaacccttcaatctggctttgttgctgccaaaggagataactgttggaagttcacactggggaaactcattttcccctgcagctcccccaaggtgcaggagggcaggatccagcagcactggggatgccgaggcaatgctgtacttgaagccagaggacccaaattgccgccctggctgtgctgcaaacaagctgtgagatcttgaatagtgttctttcatctctggaccccactttccacatctgtgcactcaagcttggactagaggacctttaagttttctttctgtttctaagacaacagtatgctgctatagccgtctgctacctcgagaagccatggcctgcctgccttttggctttgtttcaaaggaacgaccctcctcatttgggccttttagacccctgacctttccagctttgtccttcagattaatctggatgtcttttattcaaagctgagtcagtggctcttgcgaatgccccatagcagaagtcccgggaaggtaaatgccaaacccagagccatgtgagattctgactttgatcttggctgtggtttaatagcatctcaggattatttatcatattctctttttttcttattgcttataaggtgtcagttattgtttccattgttgtttactttagttctggaactgaaaccgacaggaagaaactttggaataaggaagagaagattgaccaaaccatccaaatgccaaaaag

SEQ ID NO: 14745 - DNA, 1934 bp, Homo sapiens
  misc_feature (1919)..(1919): n is a, c, g, or t
  misc_feature (1932)..(1933): n is a, c, g, or t
gctagaggacccggctcatgtcagttcttaagagtttactagattctcaaaagaatctgtgatttcctacccttaaaatgatttaaacatttttttaaaatcctcataggaacaaaatggccattttgggcaatatactattttaagcataagaatgtagctacctatcttcactaattactgtcctaatgcagatcataaaaataagccatgtttctggaaagaacataaataacaataaatggagcaaaaagaagcacccatatgttttaatcacaaagcgatcagtagggtgtaaataaaccttttgtgacactcggctgtaccatacgtcaatatgccacaagctttttgctttagtattgtttattaaatatttccacaaaacaagtcataataggaagcaatagttatttgagttttttaaaacaaggacttgtatttttcaatgctgctttcttttataacatctttttacttcccccattttaggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagtggctgttcccctgtctccagcttcctcctgctcttctgcaatagaccagttcctgtctaactctgaaagtgctctgtacaccgttctgcacaggggacatcatcaggaactcgagaaactgcccatacacaatgacccagaatccctggaatcatgcttctgattgaggacatggctcacaacttagccattcattcgcattcatgtttgcatgaacaggtcaccctggcatcacttctgaacctcatcaccaccagtgaggcatcaggtagtaggctgagagcccagaggaggtacatggnggacagtgttggnng

SEQ ID NO: 14746 - DNA, 1730 bp, Homo sapiens
  misc_feature (1690)..(1690): n is a, c, g, or t
  misc_feature (1692)..(1692): n is a, c, g, or t
  misc_feature (1726)..(1730): n is a, c, g, or t
gctagaggacccggctcatgtcagttcttaagagtttactagattctcaaaagaatctgtgatttcctacccttaaaatgatttaaacatttttttaaaatcctcataggaacaaaatggccattttgggcaatatactattttaagcataagaatgtagctacctatcttcactaattactgtcctaatgcagatcataaaaataagccatgtttctggaaagaacataaataacaataaatggagcaaaaagaagcacccatatgttttaatcacaaagcgatcagtagggtgtaaataaaccttttgtgacactcggctgtaccatacgtcaatatgccacaagctttttgctttagtattgtttattaaatatttccacaaaacaagtcataataggaagcaatagttatttgagttttttaaaacaaggacttgtatttttcaatgctgctttcttttataacatctttttacttcccccattttaggaccctgtgggcattgaaatccaactcactcggtgcttatttcctgtaatggacaaacttgatgctaatgtgagttctgaggagggtttcgggtcagtggagaaggtggtgctgctcacgtttctctcgacggttatcctgatggccatcttggggaacctgctggtgatggtggctgtgtgctgggacaggcagctcaggaaaataaaaacaaattatttcattgtatctcttgcttttgcggatctgctggtttcggtgctggtgatgccctttggtgccattgagctggttcaagacatctggatttatggggaggtgttttgtcttgttcggacatctctggacgtcctgctcacaacggcatcgatttttcacctgtgctgcatttctctggataggtattacgccatctgctgccagcctttggtctataggaacaagatgacccctctgcgcatcgcattaatgctgggaggctgctgggtcatccccacgtttatttcttttctccctataatgcaaggctggaataacattggcataattgatttgatagaaaagaggaagttcaaccagaactctaactctacgtactgtgtcttcatggtcaacaagccctacgccatcacctgctctgtggtggccttctacatcccatttctcctcatggtgctggcctattaccgcatctatgtcacagctaaggagcatgcccatcagatccagatgttacaacgggcaggagcctcctccgagagcaggcctcagtcggcagaccagcatagcactcatcgcatgaggacagagaccaaagcagccaagaccctgtgcatcatcatgggttgcttctgcctctgctgggcaccattctttgtcaccaatattgtggatcctttcatagactacactgtccctgggcaggtgtggactgctttcctctggctcggctatatcaattccgggttgaacccttttctctacgccttcttgaataagtcttttagacgtgccttcctcatcatcctctgctgtgatgatgagcgctaccgaagaccttccattctgggccagactgtcccttgttcaaccacaaccattaatggatccacacatgtactaagattttgagctccttgaggactgtggccaattcttattgctcattttttttcttagtgcccaacacaggtttttntncactgaagttatcaaataaattcattggatgtannnnn

SEQ ID NO: 14747 - DNA, 532 bp, Homo sapiens
tctccctactgtatcctacacgaggctactttggtgctgtaggttgggaacagttgcagagggcttttaataccaaacagcatgcaagtgtcctcgtgcaggaaaaggggggatggtgctgaaggagtcttaaacgtggtagctctgtgctagagagtggtaacctgatggctcccggaggaggtggtattaatccttagcatcagggcaaatcttgagactctgtcctctctttatggccaactggagggtatgaaggactctttccctagggtacatagctcacaggatagatgtgtgttttatagtattaagccacaaagtaattaataaacatagccacaatgtgctgcaaatagaaggcaaaagagccaaaggaggagagactacagacacggcactgtccgttcttacgcagccggtgctggcatgcacctctgtgaacaaagagcatgtgttccagtgacatgcttctttgtcaggggcttcactgccagaggcataaataacacaggcagagcaggaaaaaaat

SEQ ID NO: 14748 - DNA, 692 bp, Homo sapiens
atccaacccaaggttcaggacatctctacagtggggactaggcagctcctctgttagacctaagaaaactcgggttgtctgcccaacatcccacctgataagcaacaggaatcattagaacagggaggaatgtgaaaccttgccattcctggcccgtagcaattccaaaatcccagtaggcagccactgtggggccacttcacctaggctggcagatgttgcttgtttaggactgggttccattctttagcaggggtctccccattccattgtcctctgtggcctctggcttcaccctctgctaggttctttcatttccattatcctccctttccatcctccttttcggccacacccaaaagagacattcaagaatttcttggaggttgtgcagccttctcaatcctcatcctctaggcgattggagacccaaggaatattttaagttttgaacagacacttctggaacctgggcttgtgagtttgttttatttttgtcagaataagcttcaaaaatgtagtaggaattttacctgattgattgcaatcagtaacatgggccagaagccacactcagttcttttttgtgactcagttctcaaatctgctgtatttcttcactcccttacccttatgcctctctagatttaaactttgagtctagatttaaacctgtggggcttctgtgcaaa

SEQ ID NO: 14749 - DNA, 782 bp, Homo sapiens
atcccatgaaactgcaccctaacatctactggccatagataaggcaagctctgtagattaaaggaccccaaaaccactgctgcctttctgaattctctgactcagatccctcacacttaactgctgaatgccatcccctaggcacttaagccccctctcaggttcccctctttactgagagtttccttgccctcctccccatctggtggtagccttgcagctgctgtctctggaaggtcacctgctatgaaggaccacccctatcaggcaaccctttccaaacactgctcgataaagcctgttctgtggtacattttcttgatcagctcggaagtcctggaactcacaactggtattacatttcctttctttttagctatttgtttttgttctagagttcttggcttccccatctcacataccccacacatccctttaaattacctgcctttgtcttctcctcaagcttttttaagttatcaagggttacattaaatggtccttctgttccctgtggaactgtttgctgcacaggttgctttccagcttttatcttgagacttccctttcctgtgttctcagctagggtcctgcgtggtcctcccatggtttcctttttctttgtcctccctgcccccgctaactgcctaagtaaagaaagtaactgcctaagaaaagtaatttgtttgaatgcttaaatgccttaaaatgatttttttgtcttttattctttcttgataattaggctgaggatagaattttaggttgaaaattatttccct

SEQ ID NO: 14750 - DNA, 658 bp, Homo sapiens
cagatcatcggtcccccgcccccaactcttgtatttttccagtaaagttctgtatcctgtgaagatacagaaagatcacgtatgtattagactttgggccacttgaaagctacgtctgtgtttactgatcccctggcctctaacatagcacttcatgagttttgaatcaatgaagggactaacagaaggagaaggttatttctgtttcctattggaaatcccttggaaatatctcttgtggtcgcatttctatcaggatggctacactttgcatctggcttcctaggagaagggtttatttggggctcctttttcagcaccacctggcagagctgcttgtgcttgctgtgcttagaggttttgctgcagtctgtccctgaatgggaaggatgggaatcgtggctgaacgcagctggggtttccttctctcccagatttacagctttaaaggcaccctgagaaagcatgactcatcaagtcacagtcttggaggctcttgggaccaatcagggcagctggcatgaggacaacgtgtccagctttagagtcagtggtggggtcaccttccagaattccccagtgcagctcagaaatctggctcttttggaatgttttttcttacttttggttgtattttgtaaagctgtaccattttatt

SEQ ID NO: 14751 - DNA, 471 bp, Homo sapiens
cacacagacacaaacagcacctccacagcctcgcagcgtcatggggtgggaacggtgagaaggtttaaaaagctccgcagggggccagtcatggaagtggccaggaaaccctggtctcctgccgcctgcgtgtggccagccgtgcttccggggcgactgtggtgcggctccttggggtgatgtctcctggcaggcgtgaggccaggactgcatgtgttcagactccacgtcctgggctgagctgggctcttccggggctctgtcaaggcagaaagtgtggcccaaggaagcagcggcactctcagtcggaaacgtattcctaacaggtgtcgggcagaaagtgtggcccaaggaagcagcggctctctccgttggagacgtgtcaccaacaggaatattcacagtgggtgtttaatttgtgtgcttaaaaagaaaaattagctttggattgactacacacattgcatgaca

SEQ ID NO: 14752 - DNA, 426 bp, Homo sapiens
atacattcaatcattttttttaaaactttgactgaatgcttaccagatgtataccagatccagagaatacaaaaatgagtcagaattgtccttaagaaaattttctgcatcggaattataaaattataaaacttggaattacaggctgggtgcagtggctcatgcctgtaatcccagcactttgggaggccgaggcaggtggatcacttgaggtcaggagttcgagaccagcctggccaacatggcaaaaccctgtctctactaaaaatacaaaaattagccagtcatggtggcaggcgcctataatcccagctactctggaggctgaggcaggagaattgctcaaacctgggaggcggaggttgcagtgagctgagatcgcatcactgcactccagcctgggcgacagagtgagactccgcctcc

SEQ ID NO: 14753 - DNA, 283 bp, Homo sapiens
aataaccaataatcaaaacctgtgagcttagacctgaggtcaaatcctagtttattcacatactaatagcgggtaatttttggcaagttgttaaatattttgtgcctctgtttcctcatttaataaagactgtactcgagaacaattaaatcacaattcccagcctggtgtgcactggttcacacctgtaatccaggcactttgggaggcagaggtgggcagatcgcttgagctcaggagttagagaccagcctgagcaacatggcgaaaccctgtctccaca

SEQ ID NO: 14754 - DNA, 277 bp, Homo sapiens
gatgtcagacccctcctagttgtataaacaccttctcatgatacttctggtatgatcagtaaagtaacagcatcaaaatgtctttgatttgataaaaagtagttttaaaaaattaaggcttaaaaatttgccttgcgtgattgtgaatttgttaataatatgccttctttatgtgttatacaaaactgagacatgagttttaagatgatagatcattataattttattagtactcataaaagattaatgtcaatacattaaattaatcaaaactttg

SEQ ID NO: 14755 - DNA, 290 bp, Homo sapiens
tgtagacatccaattgatcaatagctggtcagaaaccatcgtatttttttagcacatatattcagcctaacatttttctaaaagtcataataaatagttttccttctactggagaaaattagacatttagcatactttcactttctcctcgctcctttcctgcccaattctcaccactgccatgttaagatcctactttttagtataaaaatatgttcctagttttatatattttacctagaaatcaatttacaattaactacaacattctgctgtttcttttcttgtca

SEQ ID NO: 14756 - DNA, 449 bp, Homo sapiens
attaaccatggcagcatagaagtctctgactggaccaaatggactggtgataaagcctaaggtccagctctgtgatcttggataaatggttcaacccctcatgacctccgtcccttatctaaaatgcaggttagactcagtgattggtaaaggctctcatagttcctttttctctgactctgtacccagactcagggagcaaaactgtcatttgccttggtaggctttttgatatctcctgaaaaagcagcttcgggaggggatttagcttctgctaattcttcttcacaaagacagtgaccatttctgaatgtctggctttaaaaagtgtaacaggtggttggactctgcagagacctcgggttagtctggcactgccccttaccacctatatgaccctgggggaattattcacctctctgctcccaagttttgtatattaagggtaa

SEQ ID NO: 14757 - DNA, 392 bp, Homo sapiens
ccaacagaacagactgaactgtatgcatggagtcaaacccacagacgtgcagggttgccaactgaacaggccatttattgcaagaccacaggtaagaacaatttggaggccaagagagaagtcacaacacgatgagctcagccaagagaaggcagtaaaggagtcaaaagaaggtgtttgtggctcccaagactattgctccaaaaggaagctcacctgggcacacctttgtcagcccctccttttcttctttcctggggagtttgagtaagctctttcctccactgggaatgttatctcctcttttcttcatttggttcatggctactgatttttcaaatctcagctcaattgccacttcctccaggaagctctccctgaccccctaactt

SEQ ID NO: 14758 - DNA, 435 bp, Homo sapiens
agacagagtcttgctgtgttgcccaggccggtctcaaattccagggctcaagtgatcctcctgcctccggttcccaagtagctggaactacaggttcacatggtgcccaacttgtcattgaattttctattctcactatttcactttacaagggtaatttttcctaagccatcactatgagcattgtatcacttaacttaatggctttcactttctggaaaaaaatgtattttatatgctttgatatgatttttccatagtgataatatcatggcacaatagtctcagtaaaatctaagtagttaatacaaagaactatacttcaagccaggcatctgtaatcccagcacttttggagaccaaggtaggaggatggccagaggccaggagttcaagaaacctgggcaacatagtacgaccccatctctaggaaaa

SEQ ID NO: 14759 - DNA, 539 bp, Homo sapiens
ggcataaaaagaatgatagtaagtagcataaaatatgaaaaagccatcttttcttgaccttttggctaagatcaagtagagtaaaatatgaaatatctagctgccaaagatgaagacttttagaacaaaatctcaaatctcattttttatttcatcatgcataccaacaaagtagatatttttgcatgaaaagcttattattctattccttttagatctcctatttttctaactatattttttgaaactgcatataattaaaactgctttataagttctgatgtgtcaatgttcagaggctggttgccctcaaggattcacccaaagataaaaagagaattcagcctggcacagtggctcatgcctgtaatcccagcactttgggaggccaaggtgcttgaggccaggatcacttgagtcccggagtttgagaccagcctggccaacatggcgaaaccctgtttctgccaaaaaacacaaattagccaggcataaagaacaaaacaaaaattagctgggcatggtggcacatgcctgta

SEQ ID NO: 14760 - DNA, 294 bp, Homo sapiens
gctgccgcctactactactaaattcgcggccgctcgaccaggcgcctgccaacatgcccagctaatttttgtatttttagtagagatggggtttcaccgtgttggtcaggctggtctcaaactcctgacctcatggtctgcccacctcagcctcccaaagtgttgggattacaggcatgagccaccatgcctggccgatgtctttcttctaacactacatctgtagagtttgaggaatacaaagcaattctccaacaccaactagttgtttaacattttaaatctcacaccacc

SEQ ID NO: 14761 - DNA, 1400 bp, Homo sapiens
agtagggttggttacagctgagcatttgccttatttgaacctggtttgaagagttggctgcctgtggttggctgaagttcagctgctgtgattggctgagactcactacttgttacaagagtaggttacatatcaagttttacatatcaagttgaaatatagttttttatgtactgggaaacctttagggtaaacttaaaatatgtaaggaggcagctttaggccacaatgaatttaacaattcctccttttggtcaacctgtcaattttgagaggatgattaattttgaggttgcccaaaactttagacattgacatcactttttatcatcataaatagagttatttggtctctaatcccattggaaaatagcagaacactggattttgtaaggtgggaacaaggaaacagtatagaaaaaaaaactgattggttaacatcagattacttttttatttttttgccactgcactccagcctcggcaacagagcaagactccatctcaaaaagaaaaaagaaataaaaataaaaagtcatgcccagctattttgggagaactgaaattacaactctatctgagaaaataaaatgacaggactccacagaatccatagataaaaacttaactgaagaggaatatggaacagactaaaggaaaaattttatcaagctgtaatctttatacttgtgcctaaggccagaacttgaaactgctgaagacagtgtttctctacaaatgcacacaggcaccccattttgatgcacagataggtgtttatttcttttaagaatagcagctttattgagataaatttcacatatgatacaattcaccaatttaaagtgtacaagtcaatggttttcagtataatcagagttgtactaccatcaccataatcaattttagaacattttcatcaccgcccaaaaaccactgtagtctctccccagtcctccactcctgggaaccattaatgtactttctgtctctatagatttgcctattttggttattttatataaatggaatcatacaacatgtggtcttttgtgaatagcttttttcacttaccataatgttttcaagattgattcattttgtagcaggtatcagtcctttttcctgtttattgccaaataattttccattgtacggatagatcatattttgtttatccatttgtcacattttggttgtctatcagttgatagatatttgtggtgcatttaatttttggccaatgtgtaaaacttattttgctctcattgaggctacatactgttacaacaatgctatttggtcaacttgactgagctggcctcataggttacaggttgttcattgttagagatgagactttagaccagactggacaacatagtgagaccctgtctcta

SEQ ID NO: 14762 - DNA, 1240 bp, Homo sapiens
ttaaaaaggcattttcaatttaacaatttaacaatttaaccctcttataagttaaaaaaaaaaaaaaagcccggcacagtggctcacgcctgtaatcccagctctttaggaggctgaggtggatggatcaggaggtcaggagttcaagaccagcctggctaacgtggtgaaacctcgtctctactaaaaatacaaaaattagctgggggtggtggtgcatacctgtaatcccagctactcaggaagctgaggcaggagaatcgcttgaacccggaggcagaggttgcagtgagccaagatcgtgccactgcactccagcctcggcaacagagcaagactccatctcaaaaagaaaaaagaaataaaaataaaaagtcatgcccagctattttgggagaactgaaattacaactctatctgagaaaataaaatgacaggactccacagaatccatagataaaaacttaactgaagaggaatatggaacagactaaaggaaaaattttatcaagctgtaatctttatacttgtgcctaaggccagaacttgaaactgctgaagacagtgtttctctacaaatgcacacaggcaccccattttgatgcacagataggtgtttatttcttttaagaatagcagctttattgagataaatttcacatatgatacaattcaccaatttaaagtgtacaagtcaatggttttcagtataatcagagttgtactaccatcaccataatcaattttagaacattttcatcaccgcccaaaaaccactgtagtctctccccagtcctccactcctgggaaccattaatgtactttctgtctctatagatttgcctattttggttattttatataaatggaatcatacaacatgtggtcttttgtgaatagcttttttcacttaccataatgttttcaagattgattcattttgtagcaggtatcagtcctttttcctgtttattgccaaataattttccattgtacggatagatcatattttgtttatccatttgtcacattttggttgtctatcagttgatagatatttgtggtgcatttaatttttggccaatgtgtaaaacttattttgctctcattgaggctacatactgttacaacaatgctatttggtcaacttgactgagctggcctcataggttacaggttgttcattgttagagatgagactttagaccagactggacaacatagtgagaccctgtctcta

SEQ ID NO: 14763 - DNA, 438 bp, Homo sapiens
agaaggtgtaagtatatgattttcaaattgaaggtcagaattttttgctccatttataattagaagaatctttgcaagccctactattgggcagacagtaggttgtcagtaaggccttgctggaggaaaaagctgaaactgtatcatcctcattgttgctgtgaataatccattgcagatcaacctgaaacatctttcaccactgtttcttgggccccacctcctgtttgtgacagcagagagtgtgggtcctcattcatcagaaacaatttgatcaagtatccctgaatccattgtctttatacgtcagatatgtttttttttcaagaaccctacttgtaactctgactaaaattattattagcaagcgaaaatgaaaagatttctcaaatccccgtccattatcatcattaattaaacatcacttcaggcgtgttg

SEQ ID NO: 14764 - DNA, 338 bp, Homo sapiens
aatcagtctagtactttcactgcagtattccctgttcttattcagattctcaaactactgacctcaaacccatttttacatatttcataattttcctcatcttcctttacctccattcttaccaaacttaaattccatgatccattattgcgagtattctcttgggaatattgccaatttctttttacttttctccctgaatcatgtttattgggaaaaactttacttcgaaatgaacccaactacctatcttttctataactgcattagagcagctaaagtagatggagaaaattttaaatgctggtaggtagctggtagcataagccttcatcatt

SEQ ID NO: 14765 - DNA, 370 bp, Homo sapiens
gcaaaggctagattagaagatctttatgtctgtgtagctctaaaaatactaaagcttggtcctaaaatttaaccacataattttgtttcaaatgacacaaagcactagaacagttcattgaaaagattacaactgagttcttctgactgcaagaagacataatgagtcttcataatgagcaagaagacagagtcccatctaccacgcctccccctgagttcctatagtggccccaaagtactgtatttctagcagaacccttggcttcatggatcagtgggaccaaggttctgctataaatacagattagtggctctctcacttgagagccactaataaaggtttattattgttgttgccttgaatttat

SEQ ID NO: 14766 - DNA, 1160 bp, Homo sapiens
atggtcagttgtgcccatgcgagataatttttttgtgcttgtagctaattccagtaaagaagtagatgttttagagggtaacgttaaaggggtcagctgcaaagagtccttttcctcctcctcactgttacaaaaggtgacttgtggttcttccctaattgagagcaatggcaacgccataggtgattactcattttgtaaaactctaattacaagtaggttgcttctgtgttcaacataaaaattagaagtgacttgcaaagatgagatactgcagggaggcttacaatcttgttttcagtgttagtgtttcagtacctggaacaaaatgtgatttacagccatcctttctaagaaaattgtcatcattaccaacatattgctactgataccagtccttaatgtgcttcataaaaaactcaataatttcataacccgttaaaaccggaaagaaatggagggaagaaaaataagacacttttagcgtagtcataatcttctctgccatattgtgttagaatcgatgatacccaaatgagaagatgtctgttctctgtcactgattccagtagaataaaattattgtttaaaagtaagcacatccgctgcactccagcctgggcaacagagtgggaccctgtctcaaaaaaataaaaataaaagtgagcacacgattgcaagatctatctggttttgggggcttattgtcatctttggttgttaaaaaaatacttggatattattggttattggtctagtggaataagccattaccgatttgagtacaacagtggtgtatttagatacttgctcctaattttctgttcttcaagaagggattgtacttcagaaaccagagatatcagggtagttttgattgagccataaattctaaattctgattgaaatgggtattgtaataaatggcataatcttttatttaatctagccaattgtgcctgtccagaggaactggacatttcttccttatgttcatttattcagcaactattcgttgtacccctgctgatggctaggctctttgctactgtggaaggcatcgttggggcagagcagacagcattttacctcctgggagactggcagatttttgaagcctttgttgcagatatagattttcacggtcaccactcttgccc

SEQ ID NO: 14767 - DNA, 418 bp, Homo sapiens
tattacatgttagattcttggatgctttcctattgtaaaatgtgaatgaggtcttttatctaggggaaagataatagcaaatgaaatttctgtttatgatattataggtagcctcaagtgcagtggctcatgcctataatgccagcatgttggcaggccgaggcaggtggattgcttgagctcaggagttcaagaccagcttgggtaacatgacaaaaccctggctgtacaaagaatacaaaaattagctgagcgtgatggcatgtgcttgttgtcccagccactttggagacttaggccagaggatctcttgagccttgtacattgaggctcagtgagtcgtgatcatgctattgcactccagcctgggtgacagagcgagaccctgtctcaaaaaccaacaaacaaaaaacaaaaa

SEQ ID NO: 14768 - DNA, 443 bp, Homo sapiens
ttccacttacatttttcgtagtaaatttagtcttgttaatattgcattaaaatgaacctttgaaggcaaagatgagcacataaagcagccctaatcttgtccagtttgctttctattttctccccatgggtagaagttcacctgcatggccctggcatttctattttgtgattagaaaatcacaccagccatacatgatgtttcacttctgtaatccccgcactttgagaggccaaggcgagagaatcacttgaggccaggagtttgagaccagcctgggcaacatagtaagacctcatctctatgaaaagttttttaaaaaattggctggatgttgtggtacacacctgtaatcccagttcttcaggggcctgaggtgggaggatcacttgagtccaggagtttgaggctgcagtgagcagtcatgccactgcactccagtc

SEQ ID NO: 14769 - DNA, 600 bp, Homo sapiens
  misc_feature (594)..(597): n is a, c, g, or t
  misc_feature (599)..(600): n is a, c, g, or t
gaagaatctttcttagtccagaacaaaatggagtctcctatgtctacttctttctagacagacacagtgacgatctgatctctctttcttttccccacatttcccccttttcttttcaacaaaaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctaaannnnann

SEQ ID NO: 14770 - DNA, 907 bp, Homo sapiens
tggggatggccctgcgggtccgggcgcggcgcaagtcctgctttgtctccaggtgactggctgtccaggacggcgggagctgctaaggcttgtgtccggaaggagcacagggatgggcagggtggccgggccagccggccctcaaatcctccgacgaagcggcagccgccacgaccacggccagagcagcgctcggaggcgagtttgtcaacaatcgcctcgcctttggcggcctgacccgtaggcgccgcccccaccgcggctgccgattggctgcggcgcggagcgaccgcgcgcggaccaattgggaacgcgggcacccggcgccagcggcgcggggaggtcggcggtgccggcggcggcgggcgcagagcgcgaggggaggagcgggaggaggcggaggatgttcccggcggctgcggccggggcagcgcgggccagaggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacgtgagtttcggtgtgattgccttctgaggggagggtctgtgggatgaaggcggcgcggcgcgcaccggtgtcgcctagcctgcggacctagttgtagaccttgcaggcgttcgcttcgtcgccctccgcccgtgctccctccctcccgctcccgtaccgcacgccgcaccgaatcagacagaacttctctgaggtgcacaccgtgaggtgcacatctctaaatggggagggggcg

SEQ ID NO: 14771 - DNA, 404 bp, Homo sapiens
gatatatacttggaagtggaattgctggatcatatggtaattctatttttaattttttggggaaccatcatgctgttctccatagaggctgtgccattttacattcccaccaacagggcacaagggttccagtttctccacatacttaccaacacttttttttttttttttttaacagtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtattttaatattgacaaaaaa

SEQ ID NO: 14772 - DNA, 1125 bp, Homo sapiens
tggggatggccctgcgggtccgggcgcggcgcaagtcctgctttgtctccaggtgactggctgtccaggacggcgggagctgctaaggcttgtgtccggaaggagcacagggatgggcagggtggccgggccagccggccctcaaatcctccgacgaagcggcagccgccacgaccacggccagagcagcgctcggaggcgagtttgtcaacaatcgcctcgcctttggcggcctgacccgtaggcgccgcccccaccgcggctgccgattggctgcggcgcggagcgaccgcgcgcggaccaattgggaacgcgggcacccggcgccagcggcgcggggaggtcggcggtgccggcggcggcgggcgcagagcgcgaggggaggagcgggaggaggcggaggatgttcccggcggctgcggccggggcagcgcgggccagaggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtattttaatattgacaaaaaa

SEQ ID NO: 14773 - DNA, 1099 bp, Homo sapiens
  misc_feature (1093)..(1096): n is a, c, g, or t
  misc_feature (1098)..(1099): n is a, c, g, or t
gccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtatcggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctaaannnnann

SEQ ID NO: 14774 - DNA, 1279 bp, Homo sapiens
  misc_feature (1273)..(1276): n is a, c, g, or t
  misc_feature (1278)..(1279): n is a, c, g, or t
gccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtatcggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctaaannnnann

SEQ ID NO: 14775 - DNA, 943 bp, Homo sapiens
gccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggatgactccgctggatcctccctcagaattgcccttcatagggaagttcagtggccactcaagtggttagcaaaatcaagctaactgggactagaaacagctccatcacccagtaaagagaaagaaaacatggatctgcctaggaagtcacctctgcctgagtctgctacttgcaggattggagcttttgctgcagattacagctttgaagtcactttacctcaagagcagtttatattttattgtgctttaaaaaaaaaatttagtgccaggtttatggagtgaagtgctttcataaatgctgaaactacattttctgtgggtaaaaatgcagctcatcagaatttcccctttgaagaattttttatgttcacataaaattgccaagttaaaaatttgatctccctacagagtaagagctttcatttcaaataaaaccattttatagaccaggtat

SEQ ID NO: 14776 - DNA, 1363 bp, Homo sapiens
aaacaggaaataaatacgaatgaaactgagctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaaaaaaaaaaag

SEQ ID NO: 14777 - DNA, 860 bp, Homo sapiens
aaacaggaaataaatacgaatgaaactgagctctaagcagcatgtaacctggcctgcatccaggaaatagaggacttcggatccttctaaccctaccacccaactggccccagtacattcattctctcaggaaaaaaaacaaggtccccacagcaaagaaaaggaataggatcaagagatacgtggctgctggcagagcaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgattgtgcctctcaggatgcatttcttagccgcttctaccaagcagatgtttaataaccacttgctaaatggagaggaaggagaagaaaaggggctaaggagaggcctctccagaagagagaat

SEQ ID NO: 14778 - DNA, 1304 bp, Homo sapiens
aaacaggaaataaatacgaatgaaactgagctctaagcagcatgtaacctggcctgcatccaggaaatagaggacttcggatccttctaaccctaccacccaactggccccagtacattcattctctcaggaaaaaaaacaagcatgaattcgatgacttcagcagttccggtggccaattctgtgttggtggtggcaccccacaatggttatcctgtgaccccaggaattatgtctcacgtgcccctgtatccaaacagccagccgcaagtccacctagttcctgggaacccacctagtttggtgtcgaatgtgaatgggcagcctgtgcagaaagctctgaaagaaggcaaaaccttgggggccatccagatcatcattggcctggctcacatcggcctcggctccatcatggcgacggttctcgtaggggaatacctgtctatttcattctacggaggctttcccttctggggaggcttgtggtttatcatttcaggatctctctccgtggcagcagaaaatcagccatattcttattgcctgctgtctggcagtttgggcttgaacatcgtcagtgcaatctgctctgcagttggagtcatactcttcatcacagatctaagtattccccacccatatgcctaccccgactattatccttacgcctggggtgtgaaccctggaatggcgatttctggcgtgctgctggtcttctgcctcctggagtttggcatcgcatgcgcatcttcccactttggctgccagttggtctgctgtcaatcaagcaatgtgagtgtcatctatccaaacatctatgcagcaaacccagtgatcaccccagaaccggtgacctcaccaccaagttattccagtgagatccaagcaaataagtaaggctacagattctggaagcatctttcactgggaccaaaagaagtcctcctccctttctgggcttccataacccaggtcgttcctgttctgacagctgaggaaacgtctctcccactgtttgtactctcaccttcattcttcaattcagtctaggaaaccatgctgtttctctatcaagaagaagacagagattttaaacagatgttaaccaagagggactccctagggcacatgcatcagcacatatgtgggcatccagcctctggggccttggcacacacacattcgtgtgctctgctgcatgtgagcttgtgggttagaggaacaaatatctagacattcaatcttcactctttcaattgtgcattcatttaataaatagatactgagcattcaaaaaaaaaaag

SEQ ID NO: 14779 - DNA, 341 bp, Homo sapiens
ctaatcagttcaatcccagactagaactatttttaaataattttatataaatcacgtgaagtcacatggctttaggtgacccgcccctactctaactggttgccaaatacaaaaattacttctctctgaaggcagataacattacccagaacctctgtaatttttcataaataatcatggcatctgatcaaaaattatgatgctagaaaggaagatcaagtgactacaaattaagagaaaaaatagattacagaatgacacccataggcaacccaaatattgaaattatcagatatgtaattcaggataactctgattggtatgttaagaaaataggtgac

SEQ ID NO: 14780 - DNA, 355 bp, Homo sapiens
catcacacattaaccaggcccccttctagaaccacagtacaaaagcctggatacatgcaacacattccactttgccattagacagtaaactatggggcggaaaggaaaaagttcgacaaaacgcacaaacaaagcaagcaaggaaggaagggatttattgaaaatgaaagtacactccacagtgtgggagcgggcccaagcataggggcttaagggctccattactgattttttgggagtttaaataccctccagaggattctattggttacctggggtacaccctatgtaaatgaggaggatgaagtaaagttacaaagtcatttacttggcctacatcctgtagagaggatat

SEQ ID NO: 14781 - DNA, 226 bp, Homo sapiens
gctggaaaaggtgaggaagcaaatgctcctctgcaacttccagaaggaatgcagccctgctgatgccttgatcttagatttcagactccagaactgcaggagaatagatttgtgttgtttgaagcctctaagtctgtggtaatttattacagcagcagcaggaaattcatacaaaggtattcgggggaaaaatgttccagacagtgctggtgaattcaggtgggct

SEQ ID NO: 14782 - DNA, 279 bp, Homo sapiens
tgagaatttaagtctttattaaaggttttttaaaaatcaaatgtatttatatatactgacaatgaacaatgggaaaccaaaatttaaaatacagaactaccaaaaacatgaaatatgtataaatttatcaaaatacatacaagatctgtatgctaaaaagtagaaacaccaataaaaaaataaataaatggagagatataccattattcatggactgaaacaatactgtgaagatgtcaaatcactcaaaatttataatcccagttaaaatctcagtag

SEQ ID NO: 14783 - DNA, 414 bp, Homo sapiens
ccttttggaggacttcctgctagttaagcatctggggacttagctccccatgccctatttcttctcaagggcctcagaaatcaaatccactctcctggtctttttaaagctgtcatcatctactgctctcttaggggtcctgtttccccaagaatgactgaaaaggacacaagctctctggtttctcgcttagtatcttctttcctgttcaacacccccccaaaaaaattacatcagcccttaatatttcaaaagttttatttctaatcactaccagcaaacagatgagataacaaatacaacagtttttgcaattgacaaagtttcctgagatttttctgaatgattatctcctgaaacaaaagaaaatactcaattgtgaactctacttatctttgctctcatcccaccccc

SEQ ID NO: 14784 - DNA, 791 bp, Homo sapiens
agagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacac

SEQ ID NO: 14785 - DNA, 306 bp, Homo sapiens
gccgtcaggaacctgaaagccgactccttgactagacactgccaagtgagaacatttcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacac

SEQ ID NO: 14786 - DNA, 565 bp, Homo sapiens
cagttgctctagaaaatactaaagcaaggccgggcccaatggctcatgcctgtaatccccatattttgggaggccaagccgtgaagattgcttggacccagaagttcaagaccagtctgggcaacatggcaagacctcatccctacaaaaaatcaaaatgaaaataaattagctgcgtatggtggcatgcgctttatagtcccagctacttgggaggctgcagtgagaggatcccttgaagcccattagtttgaggcttcagtgagccatatttgagccactgtactccagcctaggtgtgacagcgagatcgtgtctcaaaaaaaaagaaaaaatattaaagcatttcttgataacatgtttcttaccaggaagtcaggcagaactatatattataagtagttgaatctgttgcaacaccatctttttgatactctttacttttggtcccaaggagaaatgaaaaggtatgaggcacatgtgttttacttaaaatctcttactacccattctaatacacatttttcatggcttccttccctgtagagactgcagcactgtttta

SEQ ID NO: 14787 - DNA, 419 bp, Homo sapiens
tgcactggggtctctggacatgcgcacttgttgtcttcctcccagataccaacaagccctctcccggcacctgcagaaaaagtggggaaaatccccgaagaggcagaaacaaaacctagtgagctgaaggatgaggctgctgaagagcctgagctcacttgttgtggcctttgtacttatgctggaaatccctaaagattcatccggaagggccgccagccagtggatttcccgggcccctcagccctctggagtgtacgagttttggagaaacctcttcctctgtatatgcttttgactttcctggactgatgtaaaaatactcttttctttgacctgtttatttttaagacacgacgtgattgtgtcagcttatattttattgctgaagtaaattttcaaatgttttattagttatt

SEQ ID NO: 14788 - DNA, 1830 bp, Homo sapiens
ccccagcgcccactggggatggcaaagacgacatccggtgcgccgaggctgctcacaaaatcactcacctgtggcgcccttggccgctcagtcaaggctctgaatatcctgagactgccccactgcttggaagccccggacaccagagagtttcctgtaggtcctccagccgagcccgatgaccccggcaggcccgggagtgatgtccccctctggatgatcccaaccccttgctgtggattcagccccagccgttgttgtgtcttttggggaccttgtcagttgccttccaagtgctaattctcatgacgagataagaatggctatgactgggtgttgattgatgagtcgaacacattgaatcctggagtttgaggttatcagaactccccacttagaaaatcatcctttatattttagaaaatcatcattgtatgttgaacatacaatgcttcttttttcttcatctccagtgcactggtctagagagcggcagttggaccccagagtgtggcacgtgttcctgtgttcatttgaacattctctgatgacctgtcgctgaggtcctgtgatgatgcgtatcctgtcttccaccccaactgccactgtgtttcaactgtcgctggctgtgtttcaactgccgctgtgttggaactgccagctagactgctcaccaaaatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtaggtcaggccacctgcttttgtcaaagaaaaaagataacccctatttgaattaaaatatgagaatctgaccatatgtatcataggtgacttacacagtgtccttggtaaggagaatttagagtgagagtctgttccccactgaggtttgatttaagatggcagaagaaaatgacatcatcagccactcagcagcttgattctctccttggggcaaaatcacttaattgccaagcaacatggacttacaggaaacatcctccaataaaaacttaggtttttagcatgattcgataccaacaagccctctcccggcacctgcagaaaaagtggggaaaatccccgaagaggcagaaacaaaacctagtgagctgaaggatgaggctgctgaagagcctgagctcacttgttgtggcctttgtacttatgctggaaatccctaaagattcatccggaagggccgccagccagtggatttcccgggcccctcagccctctggagtgtacgagttttggagaaacctcttcctctgtatatgcttttgactttcctggactgatgtaaaaatactcttttctttgacctgtttatttttaagacacgacgtgattgtgtcagcttatattttattgctgaagtaaattttcaaatgttttattagttatt

SEQ ID NO: 14789 - DNA, 1637 bp, Homo sapiens
ccccagcgcccactggggatggcaaagacgacatccggtgcgccgaggctgctcacaaaatcactcacctgtggcgcccttggccgctcagtcaaggctctgaatatcctgagactgccccactgcttggaagccccggacaccagagagtttcctgtaggtcctccagccgagcccgatgaccccggcaggcccgggagtgatgtccccctctggatgatcccaaccccttgctgtggattcagccccagccgttgttgtgtcttttggggaccttgtcagttgccttccaagtgctaattctcatgacgagataagaatggctatgactgggtgttgattgatgagtcgaacacattgaatcctggagtttgaggttatcagaactccccacttagaaaatcatcctttatattttagaaaatcatcattgtatgttgaacatacaatgcttcttttttcttcatctccagtgcactggtctagagagcggcagttggaccccagagtgtggcacgtgttcctgtgttcatttgaacattctctgatgacctgtcgctgaggtcctgtgatgatgcgtatcctgtcttccaccccaactgccactgtgtttcaactgtcgctggctgtgtttcaactgccgctgtgttggaactgccagctagactgctcaccaaaatgggaggcagcctctgctgctgtggtgaaggtgaaggcttcttctaccgccagaattggcggtttctctcgctggattcttgggacctgatccaggcagcacactcgacacactcagcgattcagctctacagtatgcactctgggatctcccatttgctaaggaaggatcttagctttgagaaagtggcaagagatcccctcttgaggagactccgcaggaacaccagagatgatagtgacacacaacaactgaaggcagaggtacaggctgaggagaaaggtgtcaagcctgtggcagcagagcttcctggggagtcctcagagcaagtcattgccattgtcgaagtgtcttctaggctttattttggggccattacctcgagcactgtttcttgtctggtttcctaatgtcagcaactgaagaaaagacctgtatacacaggacacagcatggtctgacgctcacagtgttttcctttctctctgcagagggattcagcactttgggcaagtggttgcacagaggatcccgtggaagaattcatatatgaatcagatgagaatgccccaggaccatcgtagataccaacaagccctctcccggcacctgcagaaaaagtggggaaaatccccgaagaggcagaaacaaaacctagtgagctgaaggatgaggctgctgaagagcctgagctcacttgttgtggcctttgtacttatgctggaaatccctaaagattcatccggaagggccgccagccagtggatttcccgggcccctcagccctctggagtgtacgagttttggagaaacctcttcctctgtatatgcttttgactttcctggactgatgtaaaaatactcttttctttgacctgtttatttttaagacacgacgtgattgtgtcagcttatattttattgctgaagtaaattttcaaatgttttattagttatt

SEQ ID NO: 14790 - DNA, 711 bp, Homo sapiens
aagcgattctcctgcctcagcctcccgagtagctgggactggaggcacgtgccaccatgctcagctaattttttgtatttttagtagagatgggtttcaccgtgttagccaggatggtctccatctcctgacctcatgatctgcacacttcagcctcccaaagtgctgggattacaggtatgagctaccacacccggccgatttgcaaataatttctcccattatgtaggttgtcttttgattttgttaatagtggcctttggtgcacaagtttttacttttgataaggttcaatttttctgtcttttgttgtgtgttctctggtgtcacatccatgaaatctgccaaatccaatgtcatgaagcccttctcttttttcttctaagggtttttagttttagctcttatttgtatgtttttgatccatttttgagactatttttgtataatagtaaaggtccaacttcattcttttgtgtaattcatttttaataggatagtagtgtaccatatacgctgagattcgttatctggcttttttcactcaataatgtgtctcagccccagtgtttttttttcatcctgtcctccagtagcctgttgagtggtgtgagtcaatatgtaggaaagcttttgaacatggctcccttcactaacagttaaaattaaaagaaaatcaagtaggattgttaaaccgaggaatgaaaagtg

SEQ ID NO: 14791 - DNA, 418 bp, Homo sapiens
gagtctcctatgtctgtctactttctacacagacacagtaacaatctgatctctcttgcttttccccacactgggcgtcctgtctgcacagtgacccagtgatggtcccctggcctggaggcctctctgggcagctctgcagccgcagcgccttgtctctggccaattgtgcagggaccatgggagggtagtcaggggagaatcccgactcgggtgagggttcatgaatgggaagagttttggtcggtggggttcctagtccctcttttcatctattaaaaatttatggagtcaccgcaaaaagattaaagaatttaatcaaagagtggctcaaaaattgtagagtacccagctatgggttttagtttgtggttcatgggaggaacttgaaggaaagacttttataaggtccatgatt

SEQ ID NO: 14792 - DNA, 553 bp, Homo sapiens
tgcctatgctactatgtacttgcattttactacttctgaattcattaattttcttgctaaaataaatagtcgtattagcatggttctactgggggttggggaagaatgaatcataaatgccttcctttatatttactcttaagataattgtttagttcaatataaaataataaatccaaagtcttttttctttagcagtttgaaaaagttactacactgtcttctggcctccagtgttgctgatgagaagtctgagctcatgctttttttttcctttgttaattacttttattagtagttagttatgtttttgttattttactttttttttttttcttaagagatgtggtcctcaagcttggccaacatggtgaaaccccgtgtctattaaaaatataaaaattagccaggtgtggtgccacatatctgtagtcccagctactcgggaggttgaggtgggagaatcgcttgaatccgggaggcagaggttgcagtgagctgaaatcgtgacactacactctagcctgggtggacagggtgagaccctgtctca

SEQ ID NO: 14793 - DNA, 404 bp, Homo sapiens
gaaattattttttaaaatctcgtcttgctggtagacaggttttttagagacagggaccgcatcttctttaatctttgctgtatcccttgttcccagcatattgtctggcacagagtatttaatacattaagtgggtgaataaaaaagtgaatggcgccgggcgtggtgtctcacgcctgtaatcccagcactttgggaggccgaggcaggcagattacctgaggtcaggagttcaagaccagcctggccaacatggcaaaaccctgtctctactgaaaaatacaaaaattagccaggtgtggtggtgggcacctgtaatcccagctacttgggaggctgaggtaggagaattgcttgaacccgggaggcagaggttgcagtgagctgagatcccgccactgcac

SEQ ID NO: 14794 - DNA, 477 bp, Homo sapiens
taagggaaaaacgcctcaagtgagcatgtgcacagcttcagtaaacacactgcacatgcggctcctcccaagtgctggcaggccagtgcgaatgcagacagcccaccccaaaggaagaactgggagaagagatgttacccactggaagcatgccagtgtataaagccccgagtcaaaggtcaaactgtacacttgaatctttcacgttacctgcttggccctcttccaagtgtacttttttaaaattcctgctctaaaactttttaaagactttcactcctgctctaaaacttgcctcagtctctccctctgccttatgcccctcagtcaagttctttcttctgaggtggcaagaattgaggctgctgcagacctgtacagattcactgctgctaacactttcacattccactgatcaggactcagttgcatggccacagctaacttaagtgaagatggaaaatgtggtttaactgt

SEQ ID NO: 14795 - DNA, 408 bp, Homo sapiens
ctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaa

SEQ ID NO: 14796 - DNA, 598 bp, Homo sapiens
aagccccgcctctccacaccctgtcctattctttcccccaggttgctgggagaaaaacggcaggagctgctggcccaagccaataaactgcggacaggcttgttcaagatcgacgaaactagggaaaaggtgcaagtgatgtcgttggagctggaggatgccaagaagaaggtggctgagttccagaagcagtgtgaggagtacctggtcatcattgtgcagcagaagcgggaggcagatgagcagcagaaggtccagggcccacgcccaccccccgtgccccactcccaccagtgccggctactgcgtcagggaacccatgttccccccttcttaaattttctttagtgactgggtgcagtggctcacgcctgtaatcccagcactttgggaggctgaggcaggaggatcacctgaggtcaggagttcgagaccaacttggccaacatggtgaaaccctgtctctactaaaaatacaaagattagctgggcgtggtggcgggtgcctgtaatcccagctactcgggaggctgaggcaggagaatcgcttaaaccctgggggcggaggttgcagtgaactgagattgcaccactgcac

SEQ ID NO: 14797 - DNA, 675 bp, Homo sapiens
ttcagcactgtcggcagtcccctccacgctgccccagaatagggccggatagtcatccctaggaagggactacttaaataggggacccaaccctgatgagtagaattgacatctgggtttaaatttctgtattttagggaccgtttgctaagcagagagcgaacactggcagaaaagcttaccgtccagtgccctcccttggcaagctgcccatgcctggacagaagcctaatggtgaaaatgacatctgtgaactttatttttagcccagtggtgttcatgtgcagccatatgaaaatctgcccgtgtgcctttactgtgattggtctgggatgcctagacagttcacttatcttttttctgaagaccaatctcatgctttaggttgaaaagttgggaatccagaataatatttgttcattctcacttccaactcccaccatcaccgaggcgggcaaatcacaaggtcaggagttcgagaccagcctggccaatatggtgaaaccctgtctctactaaaagtacaaaaattagctgggcgtggtagtaggcgccggtagtcccagctacttgggaggctaaagcaggagaatcgcttgaacccgggagacagaggttgcagtgaaccgaaatcgtaccactgcactcactccagcctgggtgacagagcgagac

SEQ ID NO: 14798 - DNA, 422 bp, Homo sapiens
ggtacaaagagagtctatgtctcagatggaaaaatcaagacaaagggtaactgtgatttgcacacaatcaactacaacatgaaagagcattggactcaaagctcgatgtggctatagtgacccctgctggagcctatcttttaaactaaaaacctaagtcagggcttccatgagaataactaaaattttcatagaaaaactgattttgagagctgggagaacgcttagaggacatttagcataacctccttacttcataattgatgaaacaggcctttggcccagagaggttaaatgacttgctttaggtcacacagctgggattaccagaatgtaaagatgtctcctcaattcttgggcctgtttccatcagtggagttttctgttacaactaataaaagtatctataacacacaaaatga

SEQ ID NO: 14799 - DNA, 490 bp, Homo sapiens
gcacatcttgatcaaatttggatacgtttttgccttttttttacagcctcaaactctttaggttaatgcgtagttttcaaatttcttttctcatgttcaaatagcctgtttccttcaagcaggacagtctttcccttatattttcagttccagatttcctcattggattattagaggttaaaaaaattatagacattgcaaaaagggaaaaggggaaaccaacttacgtctatactactttatcttctgatttccgaaagggaaaagaagtttgttgcaatcttctgtgtttcttattaagcctctgaattttttcactgctctgtcttatagttttagtatgcttagcctggtgtgtactagacattgcctctggcactacaccacatgcatttagtgtgggcctatataaacttagtcaagcaactgtgttagaaaaaaattttattctgtggtgaaataaatcttagaatttgaatttacaaacttg

SEQ ID NO: 14800 - DNA, 3593 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttaaggatacagataaataaagttcacttatatcttcttac

SEQ ID NO: 14801 - DNA, 4928 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaatgtctgggttttaatatggttaatcacttatatacaaatattacaactttttagtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacattgtggttatttgtgcgattaggtttttttgtttgtttcttttgtgtttgtttggcgggagagggtgacctggaaagccacaagtgagtatttgacatattctgtatccttaatccaatcatttggcaaactaaaaggtttctgtgttgtaagaatctgatactagtgcttaagactttgggaagcattgcactgttgtttattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggagctgtaggagtacagtgtataagtacaggaaattgagaggaaatgtagtcattttatatgt

SEQ ID NO: 14802 - DNA, 2744 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttc

SEQ ID NO: 14803 - DNA, 3318 bp, Homo sapiens
cgcggccgcgcgggtcgccgtgcggatggccgagggttggcgatggtgcttcgtgcgccgaactccgggtttgctccggggaccgttacttcctcgctcattctctgggaaccctcgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttaaggatacagataaataaagttcacttatatcttcttac

SEQ ID NO: 14804 - DNA, 2855 bp, Homo sapiens
agtgccatagctgttccagagtgaatcgtgatcctgcatagttggagaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttaaggatacagataaataaagttcacttatatcttcttac

SEQ ID NO: 14805 - DNA, 1927 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaactcgactcgtgccgaattcggcacgagcaggactctgcagataacccccagtaccagcctggaactgggaagattcgctgggtggctagacccagaagagagacaacaatcactgcaagtttggctcataggaagccacatccatagg

SEQ ID NO: 14806 - DNA, 1283 bp, Homo sapiens
  misc_feature (1243)..(1243): n is a, c, g, or t
  misc_feature (1277)..(1277): n is a, c, g, or t
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcagcactttgggagaccaagcgcgncagatcacgaggtccgattgagaccatgagcccnacatgg

SEQ ID NO: 14807 - DNA, 674 bp, Homo sapiens
cgcggccgcgcgggtcgccgtgcggatggccgagggttggcgatggtgcttcgtgcgccgaactccgggtttgctccggggaccgttacttcctcgctcattctctgggaaccctcgtaggttaaggtgccgggatgcacgtttgccgctttttttcccggtgaaacttgagctgtgagcccagaaaccctagggaccggagcccgatggaatgaagcctccgggtccacttctcatggccttccaccctggagaaggcaccattttagcccacccagccgcagaatcccctacagctagttttcttctgtcttgtgcccactcccccggctctgccctgacagcttctggagctctctagattgaccctcgtccctgccctccagcttgtgggacgtctctcacactgcccgtgcttattttaccaaaccgcaggaacaagatttacgtgttaaatacctgatttcatggactgtgtgccccggctgttctaaccaaaacagtcacgcgcctgtttcccatctcttgaccctcgtgttatgttactgttttcctgtcatatttgggagttagtctctgagttttcttcccaggtatgccagactagaagcctgcttattaaggactgtgctaaaaaaaaaaaaaaaaaaaaagtctgcctcatgcaagagaaa

SEQ ID NO: 14808 - DNA, 1137 bp, Homo sapiens
ggaagaatttctatttaaatgttgtagtagagaagctatttttagtgcactttgtattaaatgtgcatgaattaagggaaattttgtgcaagtcctgttttaatattaatatttaaaaatatttttcaaattttacagtgtccaatgtcatttttttttgatctgggatgttttctgttttgcacttgaagtttttcaattttgttaataaatttttttattttaatagaataaaagtgctaaatgtctgtattactggtcgtttatattagagaatattgatttttaaaattaccttttagagtacaaacttaaaattactttcatctttttctctctcttcttctccaggtactctttacatatcgagaatatattctcttggtgatgtttggggatatttacataatttttaaaaagttaagctgaggtattaaagtaatataagaaagaaggaagggttttagcataatgccactaaacctaatgaatgaaatttggggtcctctaacctggctcttggataacatacttcagtcaaatagtttgcacattgtagaaaaggtatgcaatttcaagaattatttttaagattatttgaaaagcctaatttttgttactttacagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgatgaccttccacccacacataaaccacctcctctgtatgaagaacgatccccaccttggcctcagaaagacctatttcagcctgaacacttgccttgcagactcagtgtcaaagaaagagacagttggcaatcttcagcactctaatggactaaatagcaggagtttgactatgaagatgagaatccagttggggaagatggcattcagcagatgtacccccctttacaaatcaaatgtgctaccaagaacggagccctggaaaactcagtcaaaattacgaccctaagagagtctaatcggaccacgaggaacttatgggtggttttctccttttcaggggggtctacaaggtttatctagatggggaa

SEQ ID NO: 14809 - DNA, 3714 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttaaggatacagataaataaagttcacttatatcttcttac

SEQ ID NO: 14810 - DNA, 4984 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaatgtctgggttttaatatggttaatcacttatatacaaatattacaactttttagtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacattgtggttatttgtgcgattaggtttttttgtttgtttcttttgtgtttgtttggcgggagagggtgacctggaaagccacaagtgagtatttgacatattctgtatccttaatccaatcatttggcaaactaaaaggtttctgtgttgtaagaatctgatactagtgcttaagactttgggaagcattgcactgttgtttattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggttttcagtagtaagtgttgcttctaatagccatatacaggaaagttttattaaggtaacccacggctaaaattagtttgccttaagggagctgttagggagtaccgtgtattaagtac

SEQ ID NO: 14811 - DNA, 3738 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttac

SEQ ID NO: 14812 - DNA, 3795 bp, Homo sapiens
cgcggccgcgcgggtcgccgtgcggatggccgagggttggcgatggtgcttcgtgcgccgaactccgggtttgctccggggaccgttacttcctcgctcattctctgggaaccctcgtaggttaaggtgccgggatgcacgtttgccgctttttttcccggtgaaacttgagctgtgagcccagaaaccctagggaccggagcccgatggaatgaagcctccgggtccacttctcatggccttccaccctggagaaggcaccattttagcccacccagccgcagaatcccctacagctagttttcttctgtcttgtgcccactcccccggctctgccctgacagcttctggagctctctagattgaccctcgtccctgccctccagcttgtgggacgtctctcacactgcccgtgcttattttaccaaaccgcaggaacaagatttacgtgttaaatacctgatttcatggactgtgtgccccggctgttctaaccaaaacagtcacgcgcctgtttcccatctcttgaccctcgtgttatgttactgttttcctgtcatatttgggagttagtctctgagttttcttcccaggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttaaggatacagataaataaagttcacttatatcttcttac

SEQ ID NO: 14813 - DNA, 1931 bp, Homo sapiens
gggcgggcgagtcgggcgcccgctctgagagtcggtttcttttccccctcttgcgtggggcggggtggtgcgttccgagttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgatgaccttccacccacacataaaccacctcctctgtatgaagaacgatccccaccttggcctcagaaagacctatttcagcctgaacacttgccttgcagactcagtgtcaaagaaagagacagttggcaatcttcagcactctaatggactaaatagcaggagtttgactatgaagatgagaatccagttggggaagatggcattcagcagatgtacccccctttacaaatcaaatgtgctaccaagaacggagccctggaaaactcagtcaaaattacgaccctaagagagtctaatcggaccacgaggaacttatgggtggttttctccttttcaggggggtctacaaggtttatctagatggggaa

SEQ ID NO: 14814 - DNA, 237 bp, Homo sapiens
tcactttattgctgtttgggagagactttagatatacttcaccattctgagagtgcaaagattttcctacattttctttatttacctttaaccttttacctttcacatttagatgtcaccacagtttgttttgcttatgatactgggaaaatcgacgagattaaagcgtgttttgttctctccttccaaggcttctgcttctatgtcagtattgcactgttttgattaatagagtct

SEQ ID NO: 14815 - DNA, 449 bp, Homo sapiens
cccaatggaggcagaagtcttaccacacccaatcactcacagatctcagcagcctcctgcctgaagaaagtaacatgaaatcgggagtgaaagctaagagaggtacagatgggttgcctgactatacaacatattcaccacattgttaccaacaataggccggaagtgggaattttgcaatttgcactttcatggcagtgcttcctaataggtgtttatgaatagattccaaatgtgcttcagccctagaaatggcaatgaaagtcttcaaactagaagatgccttgtcagggacatgacgtaaaggtaagtcccatagtttcttctgattcacctggcacctgctgctctgccaagtggtaggaatgagaccaaggaggtttgaatatctactcagcgttactagcaccatgctgtaaccaactgagctaatcagccacccattgatt

SEQ ID NO: 14816 - DNA, 570 bp, Homo sapiens
ttagaactggaggcgagagttgtagacaaccatagtagatggaaactggtggtgatagtggtgagggttagagaaaggaggcggcaggcacaaagggagatcccctaagtctatataaattcttcccaaatctctggtttgtccctgaactactgaaacacagggtggactccaggtagcctaataggggaaaaatctgaacagatttcagttgcttaccatctggggagacagagcttatagttttgagttcagattctgactgcctgctaaaacaaaaaatctatattctctttttttgggggatggagtctcactctgtcgccaggctggagtgcagtggcacgatcttggctcactgcaacctccgactccctggttcaggcaattctcctgtctcggcctccagagtagctgggcgtggtggtgcaccctgtagtcccggcttctcgggcggctgaggtagggggatggtttgggcccgggaggcggaggctgcagtgagccaagattgcaccgctgcactccaacctgggtgatagaaccagaccttgtctcaaaaaaaaaaaa

SEQ ID NO: 14817 - DNA, 546 bp, Homo sapiens
aagcaatacttccagccatggggaagcatcggtgttctgtgttattaaagtgactccagtgcaaaggcacatatatcgtattggagtaatttgccctgactaggttagaagccaggagatggttcttcacaggtattcctgagtggcccaaggtctaagtcagctctcgtttagacaaatcctatctctgctgatcatctacctctcaccaaatgcagccatcaccatgcacagcacatgcgctcctcttgatgatcttcacagagtgcagagtcttcaggaagttctttcctcagtggaacctttgggatttctaggagaggggcaggggaatatctggaatcagaggtgaacactttacagcagcctctaaactacttctaattacgttcacctgactaaactgccaggtgataaacgttttatataaaagtaattcactatggaaagttctggatgttttccccaatgggtacctcaaaacagggtacaagatggaaacctgctcaagaaacagcaaaatgtaaactggataatggtgatgat

SEQ ID NO: 14818 - DNA, 892 bp, Homo sapiens
ggtggaaggacagtccagagcccttgtcatcgcacaggaactgctatcttcagagaaagcatacgtggagatgctccagcacttaaatctggatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttccttgcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatgagaaagtgccccctacgctctaaagattgagacttccgagtc

SEQ ID NO: 14819 - DNA, 1095 bp, Homo sapiens
agtatatcagggtgtggaaacagctctgcaccccttcttgattgctgaacactatgatgtgaatatttctacatagccaccacctttatcatttttagtgacagcttaatataccatagggtggatgcctataatttccttagacttcgttttgaaacaacatagctcatgaacctcttcaaagatgaataatgagaaagcaaaaccttctgcttcgttatagaaggaattacccaatctctcccctatcttgaaaaagaagagtgttcaccacgtggccacaacgagaggagagatttccatggagctgtcatgagggccttggatgacatggaccatgaaggcagagacacattggcccgggaggagctgaggcagggcctgagtgaactcccagccatccacgaccttcatcaaggcatcctggaggagctggaggaaaggctgtcaaattgggagagccagcagaaggtagctgacgtcttccttgcccgggagcaggggtttgatcaccacgccactcacatcctgcagttcgacaggtacctaggtctgctcagtgagaattgcctccactctccccggctggcagctgctgtccgtgaatttgagcagagtgtacaaggaggcagccagactgcgaagcatcggctgctgcgggtggttcaacgcctcttccagtaccaagtgctcctcacagactatttaaacaacctttgtccggactccgccgagtacgacaacacacagggtgcactgagcctcatctccaaagtcacagaccgtgccaacgacagcatggagcaaggggaaaacctgcagaagctggtccacattgagcacagcgtccggggccaaggggatctcctccagccaggaagggagtttctgaaggaagggacgctgatgaaagtaacagggaaaaacagacggccccggcacctatttctgatgaacgatgtgctcctgtacacctatccccagaaggatgggaagtaccggctgaagaacacattggctgtggccaacatgaaggtcagccgccctgtgatgagaaagtgccccctacgctctaaagattgagacttccgagtc

SEQ ID NO: 14820 - DNA, 413 bp, Homo sapiens
aatgttaaggattttagacttctgagatttagactttagggattatgatattcagggtggtgtctttcaggactatgatccaagccctgctctagcatatacagcacctctctcatgagcagggatttatctgctagctgctctcgggttctctgggaggctttatgatttaagtttccactcaggggcctcccctgcacccttgtctgggattgatttaagtttccactcaggggcctcccctgcacccttgtctgggattcagggggcatcagcctgaccgccaagttctgcttctctccccacaggagtttctgaaggaagggacgctgatgaaagtaacagggaaaaacagacggccccggcacctatttctggtaagtgcccggtccccaagcccagctcaggaactg

SEQ ID NO: 14821 - DNA, 758 bp, Homo sapiens
gctttgtgcctgccccgtatctatccacccaacttctggcagcaatccctccaggacccacctctgtcttcatggtttgtgtgttctgatcctgctccttggccccagaatacaccctccacatctaagctatgcagtgcctcatccccacagctgcagcgattggtttaggaatgggaaaataatccaatcaaagtaagattgtctaatatctgatcccgcttaccccggagccagaagtcccacctttccaggctcctccatgttcctttctggagcaatgaggaggaaggttcattcccttctcagggaacttgctgcggtgtcccagtcctgactgtcccctctctacccctgcctgtggctctcccgtctcctggcattctaacctgccactgaattcttcccacgccaaacgcaggttaggaacctaagctcggatgaaatgctggcttagacctcattgctactgagaagcagaaaccacactttttagttggtagaggtggatgtggattggggccataaagtttcctcaatcattgaataaggatttcattatttggactaactaaatacattagattatttatactaactaaataaattagatttatttttcgaagtttaaaatcattttcaatagtgacgaaaaaggctgtagatgagatgggagaatctttcgacgccaaattcttcccatctcctgcctagtatgtatcactacaccttgcccagagagggtccaggggtgctca

SEQ ID NO: 14822 - DNA, 258 bp, Homo sapiens
aataaaatattttccaattttttcaagaatgttgagcttacttctttgaaaataattgtctttgaaataactgtctatatgcttgaaagaactatatgccattccagatcaagatgtttaatgatgatctcttgatgttcttgttggttattagtaacaagaagttttactcaaactaagaggtaaaaattgttttaaccttttttacaaccattttaaatttattaagcattttacagccaacagaaatacggcaat

SEQ ID NO: 14823 - DNA, 395 bp, Homo sapiens
atgaatagttagtatgcattcatatgcaaatttgtactattattctacaactattagtgaagttacaaatttagtgtcattatattagccccattctaacttatttaaattcttttcttttttggggggggaatcattgcttgaaaatagttactaatggtattattatatagaaaatgaagagtttaatacgcctgtaatcccagtactttgggaggccgaggtgggctgatcacgaggtcaagagatagagaccatcctggccaacatggtgaaaccctgtctctactaaaaatacaaaaattagccgggtgtggtggcgcacacctgtagtcccagctactcgggaggctgaggcaggagaattgcttgaatccaggaagcggaggttgcgg

SEQ ID NO: 14824 - DNA, 842 bp, Homo sapiens
gggtgggtagggtgagcaaagtgagaaatggagtattattgtttctctttaacaagtgaggtgtctaacgttcagagagggtaagtgaatcatccaaagcctctcagccaggaagtggtagagctcagacgtgaaccaagatcctcttatgtccaaacgcaatatttccatcatccaagggaccgccatcttccacaagaacttgcaagtggtgcctctgtgttttggatgtcatcgggtgacttgaacaacacagtttagtactccttccctgaatgaaggagctttaaaaggaaacatacttgtgggaatgaggtgctcttaccttcctaaaagtcatcactgggctcagtctttatctgcttggcttttatctattttgtcaggttatcttgggtgctcagggcatagggtattggtcacagggttagtcctgagagtcctgcacccacttgatctgtaccgtggggccatctaggcagaagatcttgtgcatccttggatgaggagggcctaacacagtacctggtacatagtaggtgcacagtcattgctaagtgaacgaatgaataaataataagacaggataaggcagtgttagaatacagacttgggattcaagcatacctagactgaaatcctaggaacgattcactcctttgtgaccttgctcaagctaatatctaagcttctatttccttgcctctaaaatagagataataaggcagagcccagtggctcacgcttgtaatcccaacactttgggaggccaaggtgggaggatcacttgagaccagcagttcctgaccagcttgggcaacagtgagaccccatctccacca

SEQ ID NO: 14825 - DNA, 338 bp, Homo sapiens
caatgctgcaagtagaaaatagtattttaagaatactgttatcaaaatattacaaaaagcttaggaaattggaaaggaataaaaatccatagtcaaatcaccgagacaactattatagcattttgtatgtttcctctgtcctgtctagatctaaaaaatagttgtatactgtttttctacctcatacaagctagcacttccctttaatataaaacctcaaatatataatctcatcaagtaaatattatataacttaaatcattctctgctgtgggacatttagactgtttttattcctttgcaattagaaataaaactgtaatgttgtgcttataata

SEQ ID NO: 14826 - DNA, 737 bp, Homo sapiens
cagtagtaagaaatttgaattaaggaatcgtaagggaatcgagattatctagtttcccctcgacattttataactgaataaacaataaaaaacaagagaagtgacagctttatagcatctgattggggaaaaacacatcttttctggggctagacagtccataaataggacttggaaatggaagtgtagggggagatcccattgtacttcagtggaaaactatgcattgtctggaatctagactctggacaaagacccttccttcctggctgtttgattttgattctatgggagctatcttgcaactctgtaagctgtaggtaactgatagcagagcaaaataattcttgtctatagacgtgtacattgtgtcttagcgtagattcacccgacctccttccccagttttgcttctattagcacatttatttcagtaattttgatctttggattctccttggacattcctcactgaaaaatgaaataaaatttttggcatgtgctcttcttttgcatctgtttgagagctgcaatttttaccttcgtttcaaaattatcctttaaccaaagggacggtggtgaactaggcaggcggagctgcccactccaggtggttgttaccaggggagggcgctggccagtgttgccagatctccactttttcaagggaagctgaaaaatctcatttttgtcaatatgtgaaacttctttatgtttcaatattggcaactaattga

SEQ ID NO: 14827 - DNA, 4992 bp, Homo sapiens
ctctttttattgatacttaaaatacctttactaaaaaaatgaagccttccatttccattcccttatatttacatgaagataaaaatacttactaagtcgttgtatttgtccattctggcagtgctataaagacatacctgagcgtgggtcatttctgaagaaaagaggtttaattggctcatggttttatgggctgtacaggcttctgttctgggggaggcctcaggaaacttacaatcagcagaaggcaaagggaaagcaagcccatcttacatggcaggagcaagaggaagagagcaaagggggaggggttacacacttttctttccttttttttttttaagatggagtctcactgtcacccaggctggagtgcagtgatgagatctcagctcactgcaacctctgcctcccgagttcaagcgattcttctgcctcagcctcccaagtagctgggactacaggcatgtgccactatacccgggtaatttttgtattttcagtagatacaaagttttctcatattggccaagctggtctggaactcctgacttcaggtgcctcagcctcccaaagtgctgggattacaggcaagagccaccttgctcggctggggttacacacttttaaacaaccagatctcgtgagaactcagtcatgaggcagtactagggggatggtgcttaaccacctatgatgcaatcacctcccaccaggccccacctccaacactggggattacaattcaacatgggatttgggtggagacacagagccaaaccgtatcagtcatttttcttttactgaaggaaaattttggttgtggggttagtactaaagatagcccatgtagactttttctgaagataccccaagtggagagatttttaattaggcatttatttggcacctattgcattctaggcattgtgataggagctgggggataaaaaggtgacacagattgggtccctcttatggactcgttttttgtctcagaagacaagtctgggtgagaaagaaatttaaaatttaagttgtggaaataacacgtgtgggggaaactccttgcaattcagcacagtttggtattcagccccagcctcaacatgcagatggcactgttggatgaagccacaccatcttttttcctgggagccccacactcttcccagcctgccttctagctcagggacaacacattttgaaaaacaaagtataaatcgattatgttgcaacaatgaacttcacgttttgcctcttctcatgttaaaagagccagtatcatgaaagcctcaacagtgagctttatgaatcaaatatctgttatttctaaacaatctgtttacattatgaccaaataattagagcctatctagacttaccaaaataagatagggcataagcgatttattggtgcatcagcctttgtttgctttttaaggttcctttatgttttaaagggatttgaacaaaagacatcaggagcttacaaaggaaaaatagcttcattttggttatgagataccagagtcagaaatgacattagattgtatagaaaagacttctaattgtgtgcttacttcccacatgattataataaactatatattaacaaccttgggatcgtactcaggttgtcaattacacggatgcatctttcacttttttctttcccaagagtgagagaaagagtgaggttgtgcttaaggcagtgtggaattctacagaagctcttcttggaaaaggagttcaggcacttgtgttgtagactgcagtctgattctgttcttacttcctctcagcataagggagctttgaaaagaaaactcagacttgtatccgacttgaccagaagcaaaataacttgatcattgaagccactatttctgtgtatttgatcaagtcctcctctggaatccaatgcagccatattcatatttcggtctctcttaatggaccttgctggaaagaacattctgtgctaagaaaatggaaaataaacgtgagaaaactttaagaatgagccttcacacctcctgcagcaggtgatagctctgtacttcagagcttgtctccaggttgagaattacctgttttccactctgaggggattagaaagatactgttttaatgggttataaaacttgtgtgaagaagattggccttctccacctctcctgtgaaataaattgtttgaaaactctttgaagagaaatggcttcagtatattgttctatctctgctaccccaaagcccagagaacaaatattaagtataaattgctaggctaggtatgtcatatgtggcagctttgacatgtaaaccaaaagactgagccaagtctcaatcaatgtacaggttattttgccgaggttgaagacacactagggaaaagagacacaagctacagtatgatctatggcccctactttctccaaagaggattttgagggcttcagtatttaaaggggaaaagtaggcaggaggagaaaggaggaaagaacaaaaaaaagagggagagcatggtcacattcttaggaggctttgattcacactcactgaatccatgtgttgcacgtggcaaggaatgggtagaggaacagtcgattatgtatgtcccctgctcagtaaaactgcactttacaaaagataaacagaataggggaagaagtcaaatatgcatttatctcaggctgggcagtggggatggtttgtactctcctcttgtcccatacttggggaggccacctggggagacatggcctcttgtagctatctgtttaggaacaaaaggaaagacagtgttctgtgacccagcttccaagcttaacttttccctttggtatagtgagtttggggtcccaagatgttcttttcctttcacagatgtatgacacttcagcagaagggtgaaggctgtagaagggagagaaaaccctcttcctgtatggctattgattgactttgacttttaactgattatgtcatctgaggagtctgtgaaggtttatgaagaatgaattcaccatacaacctcccctcagatggaaatgtgtacataatgtagaagaataaggggctgtgagtttcgggggtaagaggaggggaataaagttaagactcctaatactgcttagcttctagccttgggtcttgccgcaacgcctgcccaacacctgtgtgtgtgtgctttgcaaggttagctgggacttaggtagaccccactttgtctgtcgctgacaggaaacctacacattctctgctctttctgctgtttccctgacctcgctctcccatggaattttagattcaattcagtggagttcaggttccagtgtgggttgatcaccagccgatgcaatccccctagcatatgggaaagcaaaggatcaggaggcatgagatcctagttcagtcctggcctttgcttcctggtttgcctaagtcagatgttggacatagtattggggtagggtgctgatgagtggtagttggtgaaggggccattttccacacaagtccccaagggagacagaccaattggcaaaacaatggaaagtatataatcttagctacttaaatcataagtagttctgggatactaggctctactgttctatttattccccacaacatttcctaacatttcctaggcatgaaagatgacgctgaagacatgagaaaaacaagcatcccctgacagccaggggctagcctgagacagccgccctctgatgttgtcaggaggcatcctggcgttcatcactgggctgtggtgtttcttgttccacgtaaatcgcacagaacaccaccctcagacaaggtcatgccgtgactgtgatgaagttagacaaaaaacaagaccacttaataattatcccagcatagacaaacacaaggtcactatgtaaaccacgaaatcacaaactcttcatccgagtgcctgctgcccttcaccagttcccattttagctttgctctcatctgtgctacatgagatttactaccatctcaatcagataatctcccccacttcctgacaacacccaatccaaagcacacccctattcgtggaacactcccacgaatgacctaagcaaggcctccatcctcaaagttcttctgacagctgcttactgagatgccccacagtcccccagtgtgtggtctcccaatgcactgagcatttgttcaaccacagttgttttcctaatggtctggctggaaagtgctagactgagaagtcatttcctgaggtctgctgttctcatgagggcaagggggaaaggagcgtcatacacacaaacaggatggctactggtgtgctggcacctcattgatctgcagcaactcgtcctgcccacggggttggtggttttggcccagacaccaaagaaggcttcttacaagtaactggagaaatctagacttcagtttttcctaacctgtaaaacaaggtcaaagcagttttgtaataaatagaaatgctggaaagcatgtagtgtgatggtgggcaagacatgctttgctcattgttcatagttcctggcacctccacacctccccttagagtccctcaggctcaggtgtgtctgtgtctcgagcccttgctttcctgagggatcagaacccctatttgaggcagggccttaaaccgaggagatgcggactgagctccctctgtatggagggttcaatcaatttcaggaattccaatttgctccagcagagaaggtccaagttctgtctggatcctgttatgtgtgctgaagagctttccagagtcatagggctggggtggggaggggtcatcctggtgtggacagggcatgtggcagtagagacgactgaagatgcagggacagggtccagtgccctctagtgggaagggccccccagacacctcctgattgtcctcaaaagagctgctgcacaagtcttgctcttactttgtttgcattacttgtctatgtgttttgtttttttttt

SEQ ID NO: 14828 - DNA, 996 bp, Homo sapiens
aacacctgcctcattggggcactataacaagtgaaggacttaggaaaacatctggagtatagcgcctggcacccaggagatgcttaataaatgggaaccaggattctttttcttttcttttttcttttcttttttttttttttttgagacagagcctcaatctgtcacctgggctggagtgcagtggcacgctcacagctcgctgcagccttgaactcctgggctcaagggatgctccctcctcagcctccagagtagctgggactacaggtatgtgtcacctcaccaggctaatttttttattttttatttttgtagagatggggtctcgctgtgttgcccaggctggtcttgaacccctggcctcaagtgatccttctgctttggcctcccaaagtgctgggattacaggcatggactatggtgcccagcctaggagccaacattattattattataggcttttttttcaattgcaagatagacatttcttcacattttaatgattctgaaatcagaacatatcttgcaattgatgggttcattaatataattgtagttctttacttcctctcaaaaacttgtgatcttataattgatggcatcttggaaacaaggtaataaatctctattctgttaaagaaagtgacacactttgacatttaacctcaaattttaggagtctctccctcttggggtcagaaatcccttctgaggccaggtgtcgtggctcatgcctgtaatcccagcactttgggaggctgaggcaggcgggtcacttgaggtcaggagtttgagaccagcctggccaacatggcaaaaccctgtctctactaataatacaaaatttagctgggcatggtggcatgcacctgtaatcccactactagggaggctgtggcatgagaatcacttgaacctggaaggcagaggttgcagtgagccaagatcgtgccactgcactccagcctgggcaacagagtgaaactgcatctc

SEQ ID NO: 14829 - DNA, 324 bp, Homo sapiens
tggaattgaactttcttgcgccgtaagcaattgctggtcatattctgctgctaaaagtctctttgttgtgccaagagaaataatgcagaacaaatgttatttaatttttatttactttcagcaaacacatgaatgaaagaggtcaggtaggctgtcctgggcattctgggcctggctgcggcacaccctccttcacttggcccctgccaggcaagaaactttctattcagtctttgctatctttcataaattgtatcattgctcttctgctgttcatatcatcttagttattcacaaagtctacttgataaaatggctcaaggg

SEQ ID NO: 14830 - DNA, 293 bp, Homo sapiens
ggactaaggactatggaggcttcccctctgacccatatggactaagaactgagcaccatatggaattaaatacagagggagagaccaagaaagaaagcagtttcttcagaaggaaccatagagttcaaatgacagggtgttgtccatcatgataaagactttgcctctatctctaaggcaacttattttcccaaagaactctctcatctgcagagagtttcccactttatttatttatttattttgagacggagttttgttctgtccacccaggctggagtgcagtggcatga

SEQ ID NO: 14831 - DNA, 262 bp, Homo sapiens
gatggagaaaatcatagtggaaagagggatctgaccagcactagtgagagggtccctggacctggggcacaaagtatggccaacacgtgtcagtggctctcaagaaggggtttgatggaaacctggggggtcttttggttgtcacaatgactttggggcaatactggtatttgatgggcagggaccagggataggagatgtccagcaaatgcaaggaccagtcttgaaacacaaaaacttctcacgactttcacatccaacc

SEQ ID NO: 14832 - DNA, 338 bp, Homo sapiens
atggcccaatgcagggaatttgtgttatacagtcaacgaaccctgaatctgagaaacctcaactttgcccgagagagagacattgtccttactattctcaacaacagacaaacctgcctctcctccaaatggaaatacaatctttattatgtttcaaggctgtttgctatacaaatatctttgaaaagatagtctggaacgaaagctgtcaatgcttctgctcagaaaacatatggaaacccaacattcataaagagttgtctccaacagcagcggacaccaatgagcaaattgaattattttctggacaatataataagtaactcttgataagaaaa

SEQ ID NO: 14833 - DNA, 430 bp, Homo sapiens
aaaaaaacaaaaaacaaaaaaaaaaacagatcttgcaagcactcactcactatcagagcaccaaggggaaatctgccaccatgatccaatcacctcccaccaggctccacttccaacattggcgattataattcaacttgagatttgggtgaggacatagatcccaaaccatgtcaactactattaaactttataaatgtatatctgctttttcttgaatcatttgattcatcaaatttttgaaatagcaatgtttctatttgtatttcttaatgtagaagagaacagctctttatgtgaatgagaagatcaatccccagtgctgggaatcaaataagcattacttagcctttttttttttttttttttttttttttttttttttttttgatttttactttttgcttataggttcaacgtgcatatgttt

SEQ ID NO: 14834 - DNA, 981 bp, Homo sapiens
tctataggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcaaaaaaaaaaaaaaaaaaaaagaaaaaaaaaagaaaaaaaaaacaaaaaaaaaacacgagacaaagaaagaaaaaaaaaagaaaaagaaaaaaaaaaagaaacaaaaaacaaaaatagaggggggaggggcggcgagaatcaaatacccagggcgacagagaaacaggacgacacacaacaccttgtgagagagagaaccaaccacgacgggaggagtggaaaataaagacgggacgcgcgcaaacgacgaggtggggataagacaaacgaggacgtgcgttgtgtgaggaaagaaccccctctgggggtgggaacaatgcggggacacccccacgcaaggaaggagggggaggaaaaaaacgctggtgaggtacgatccacccacgtcgttcgcgcggtaacgcgggaagatacaa

SEQ ID NO: 14835 - DNA, 485 bp, Homo sapiens
  misc_feature (451)..(451): n is a, c, g, or t
actttattgtttcaaggtgatggttgactagcgaacatactgagggtcacatgccaaacaccattttgagtgttttacatgtaatttttttccttggtcatcttagcaattctatgactaattaataatatttgttgttatttattgtacagatgaggaaactgaagagttttagtaacttttttaagattacacaataaacaatgatgaatcaagctttgaagccaacctcaccaaccacaagatcaaccaacactcttcaccaatgtgtaatataaccacgttaatattcaacatagtacgtactgctgaaagaagttgatacttattcatattaaccccgtagttttgtgtttcctcatctgtaaaagtatgtattataacaccttctctccaccttacagcgtgtgaggttcaaatgaccattcattggaagatattttttatatcntataatgcattataaaaataaatcatttttccta

SEQ ID NO: 14836 - DNA, 504 bp, Homo sapiens
catggcactccagcctgggcacctgggtgagagtgagactctgtaaataaataaataaataaataaataaatttgtatgtgtacatagcttatctcccaaattagacctttggttccttaaggagaaagaccatgtcatatactactgtcagaatatacaactgagtattccacctaccaccagtgttacttcttactagttttgttaccttgaacaaatcatttaacatctaagcctgtgcctcattgaaaaacatgaaaaaaaatacaagagtttagtggtactttgggaggctgaggcaggtggatcatgaggtcaggagatccagaccatcctggctaacacagtgaaaccctgtctgtactaaagatagaaaaaaattatccaggcgtggtggtgggtgcctgtagtcccagctcctggggatgctgaggcaggagaatggcatgaacccgggaggcggagcttgcagtgagccaagatagcaccactacactccagcc

SEQ ID NO: 14837 - DNA, 473 bp, Homo sapiens
gtaaatttcaacattatcagtccccacttttagtcaagatgaacttactgaacaactaagatgtcttactgaacaactaagaggcaatcatagacctcccgaatggggtgaaacagggtctaaaaaaatagtctctcatgaattgtttttttgtattattcctgtaaaacttgttgaaccatctgttgagagtctgtagcaaagattagaactctacagggtcttggccgggcgcggtggctcaagcctgtaatcctagcactttgggcggctgaggcaggctgatcacttgaggttgggaatttgagaccactgtggccaacctgctgaaaccccatctctacaaaaaatacaaaaattagcagggcatggtgtggtgggcacctgtaatctggaggtggaggcaggagaattgcttgaacctgggcagtggaggtttcagtgagctgagatcgcgcctttgcactccagcc

SEQ ID NO: 14838 - DNA, 712 bp, Homo sapiens
gacctttgggtcgtgtttagctcatgggggcagagctctcataagaggccagagagagacctctcatcctttccaccagaggttaaattgagaatgctgtctatgaggaagtgggtcagtcactgaatctgccattatcttgatcttagattgcccagcttccagattgttagaaatgcatttctgttatttgtaagccacccagtctatggcattttattacagcagtcctggcagactaatacaggtaccaattcctgtgaatttctctcaaaacccattatttgtcccatgaggcccttgtccttcattttccaggaaagctacatctctgtcagcatcccatactcatcactaaaactgtcaaactctgtgaagggcctgaaattttaccctccttgcaaactaacaaattagcctgccatagcttcaagatgttggcagaagatatgagtctcctggatcagagacaaaggactttattactcatggcaacagcagaagccacagtattgacatctgcactgtctccctgagccccaattcctacagagcaatactggcacatgtagtgcattgtggtacaagaaagaatcctgggtttagtgaaactggagtttttataatgggcagtaagtgtgcctgccccttgctcctgagagaggcactagctccatctgccatggctgttggctatgcaaacatctgtgaa

SEQ ID NO: 14839 - DNA, 969 bp, Homo sapiens
ccacggcctcctggttgcagctaagtggcccgtggaggggtaggagaggcctgggtgcagtggcgtgggtgtcacgcagggccgaggcagaaccaggacgacgggcacttcctggccttgtcgagtcagcaggagggctgggggtgccctgccgggtcgtgctctcctgtgctgcccacctgcggcctggtcactggggacgggagcaggtatgcctggtccctgtgctgggccccacgggatgtaaagaagggccacctgggcacggcggggcctgcggtgcgggctggcctgggaggaggacaggaagaggggagcagagcttcagtggaatttgagggctgacctaggcgtgcccccaggaggaccaagctgagcagagttgagcgtggaaaggcagggggttcgagtccgaagtaagtggaggtcctgttgggaaggatgcggtgcttcacaggtggtcttacttgagaccctgttccatccagctgcaggcagaccctgcctgggacagtcagggtgcaccggttctgtggctccggctcttaagcactgctctggaccactcctagcttgagggggttgggggaggtcaccacaggctggcggattgcttgggcagagtcagaggtaggattgggcttgggaagaaaggtgcagggtgcctgaagcaggggcagccaggcagtgtggaaccagggggctctgaggacagcgtccactctcttggcagaagtgtgcaggtcctgctgtgtctgtcccgtccctcctcccatccacctcctacttcattgggcaaactgtttccttctttggctcactcgggatcccccagcaatgtcctttgttctcgaactcccagtgactcgaggggtgtcctctgattgctcacctcaggtggagcctcgaaaggatggcgctgctgttcctacctcgggtctccccagtgcacggcatccttacctgtgg

SEQ ID NO: 14840 - DNA, 472 bp, Homo sapiens
ttcgagaccagcctcacatggtgaaacccgtctcttaataaaaatataaaaaattagccgggcgtggtggcaccatgcctgtaatcccagtcactcaggagactgaggcaggagaatcccttgaacccaggaggtaggattgggcttgggaagaaaggtgcagggtgcctgaagcaggggcagccaggcagtgtggaaccagggggctctgaggacagcgtccactctcttggcagaagtgtgcaggtcctgctgtgtctgtcccgtccctcctcccatccacctcctacttcattgggcaaactgtttccttctttggctcactcgggatcccccagcaatgtcctttgttctcgaactcccagtgactcgaggggtgtcctctgattgctcacctcaggtggagcctcgaaaggatggcgctgctgttcctacctcgggtctccccagtgcacggcatccttacctgtgg

SEQ ID NO: 14841 - DNA, 418 bp, Homo sapiens
tgaaatgctccttcaaacgttttactcattcatcaaccatattctctatactatgtgtagacgttacttgtagtctatgtgctttataaatcttctttcctgatctctgacctctataaacataactttttattgtaatcagaacaaaataatgaatatgtactttgctgcgtagtgatttttgtatccttcagaaaatctttgacaactgtaacatcaaaatgcattttagtatgttttttgctgcaacattattttatatgttacagtagttctatgatgaatctcaaataaattattttgtattttgtgaggaagaatatgagactcatttatttttccatatggatatgcacttgatctgccatcatttatttcaaagaacattctttccagaatggccccttttagttaaatc

SEQ ID NO: 14842 - DNA, 489 bp, Homo sapiens
cccgggccccactcctgagattggcggttaggcaggctgcaagtactatgccagtagtgacttaagaattggtctggaaaaagaataaaatgagtgtccttggtagagaaaagggaagagctcccagcagcatgcaacccagagcttctcttcccctctctcccaccgcgctatagcacacagcacccgaggacccacaggttagctgatggaccgcttcagttagatggcagggaaggtgatgagggcgctggcttaggtctatcctagcgttgggtgtattttacccacacacagaaggctgcacctcaacggaaggcctgatcctccttcccagcaggtgagagtgtgggagctagttcaggtcaagtgcacagtgggtaacagggtggctcacacctgtaatcccagcacttgcctcgacctcccaaagtgctagaattacaggtgtgagcctccgcgcccagccagttcttctgtttttaaagt

SEQ ID NO: 14843 - DNA, 267 bp, Homo sapiens
aagctaacaaattggtctaggtctagaatggcacttaagggaattagctttatgtttacagtgatttatcctgtcagctgttcttcattttcctactaagacctacttgccctctgcttcttgctctttgctggttgataccattttttaaaaaggttgctaaagttgtaatgtctggcgaccccccagccctcagataacatgcttctctacgagcaagaccctcagtgtctgcaccacagcattttagaggctctggcttgtggg

SEQ ID NO: 14844 - DNA, 743 bp, Homo sapiens
ctaagttttcggaggcctccccagccatgtggaactgtgtgtgagttaaacctctttcctttgcaaattacctagtctcaggtagttctttatagcagtgcaaaaatggacgtaataagtcttatgtacttattggtgagagagaaaatccgtgcattgttttcaaaagaattcattaacgtatcaattcaatttctataacctttgaagtggcagtaaatatgtagtaattgatacttgggagatagttgcccacttgggcaaaaacgcatgcagaaggtggagtttttaaatttaaaacatttttaaaatagcaaatgttaatattccagtttccattggtaggaaattttttagataagttcaggcatatgtatgcaatggaaagccactagaaatcttcaggcacacagataatgacaatgcaggttgctcatgaagtatttagtgaaccaggagagttttagaacaacaattatagcatgaccccattttgttagtatgtttttctgtgtgtatgtttagagcaacagagaaaaaaagatgtgggagaggacatataactacttatctctagtggtgggattctgaatgtataatacatatgttgtacttttatgtattttactttgtaacaaagtatctttcagttttataataacagtagagctattttttataaattagcctgatggaacaatcccttatgattaaagattcatgttgtaacctctaaaaaaaat

SEQ ID NO: 14845 - DNA, 482 bp, Homo sapiens
gctccccaggagtcactgggggccagaaatgagtccagtgtgctctaaccccacacaagttcccagcttcctcccccttcagcccagcttctgtgtcttctgtctactcgcagtgtcttccctctgaagatctgctaggagcgtgccagtcatcctggttccttggtggcagctgttccacccggctgcatgtagtcagctgtcttgcccaaatctcccccaacactgtgaagcctaggcgggaagatcgcttgagcccaggagttcatgaccagctgggcgacaaagtgagaccaccccccgccccagctctacaaaataaaagtataaaaaccagccaggcatggtggcttgtgttgtagtcacagtacttgggaggctgaggcaggaagattgcttgagcctgggaggttgaggctggagtgagccatgattatgtcactgcactccaacctgggtgacagaaggacaccctgtctcac

SEQ ID NO: 14846 - DNA, 467 bp, Homo sapiens
tcttcagttaaagaggcaacagcactggagagaaagccagtcagtctcaggcacggtggggcccagcgtagatcctagggtacattgaaaactaactatgaaaagctggtccctggctcagcagcattagcaaatgccggacaggacagaaatcatgtagacctcacttttaggatggcttatgctcccagctccttgctcctcactccaccagagctgtgggattcctgaaatgataatctagaactacatcacatggttctacggtttatgatctgactggcagatgctgacagcatttctaagaacggtaaaagacctaacgaaaacccactcacactacttttgccaaacatctgcctcagacagatttattctcaattagggataaatagacttgacctgttctttgaacaaattacacagcaaaaatgaaaagaatatgcatagctctaatgggttagtgg

SEQ ID NO: 14847 - DNA, 266 bp, Homo sapiens
aaaaaaatgctttatatgtagtaaaatgtgtagatcttatgatacatgtatatagtcattgtaactgattgcagtcaaggtgtagaacacatccatcactccagcaattttttcgcagtattccattcagttaatatcatctcccatgagaggcaccattgttataatttctgccactatatattagttatattagttttactttttttgaatattgtaagtagaattctgattccatttattaatgattcttttttgtgtatacc

SEQ ID NO: 14848 - DNA, 412 bp, Homo sapiens
cagtctggacaacagagcaaggctctgtctcaaaaaacaaaaaacaaacaaaaaaaagatcaagttgtattaaaaaaataaaaaaatacaaatgaatgttgtctagtggagaataaaactctttgtaagtcaaattctcatttgaattgacttatttcatttatattcacattaatcagtgagttaaataaaatgaatgacatatgtttattttatatttacagagtcacagttttgccattttgaaaattatgcattttcaatgtaattaatgaccagatataaaacctagaattaaaaaaaaaaaaattataggctgaactttgggagaatcccagaatttttggaggctgaggtaagcagatagcttgagcaggaatttaacaacaacctgggcaatatggcaaaaccc

SEQ ID NO: 14849 - DNA, 441 bp, Homo sapiens
tcataccttctccttctatgagtgctaagaaatccaataggaattttattcacaaggaacaatccctcctgccccaacccaaggcttcctggattctgtgctagagaaaagactgagaaaacaccaaacagtcctatgatataatgtgaggagcttcttcttaagatatcattgcttttaaagttttcatatgatgctgattttgttttttgtgtttgtgtgtatgtgtgttagaatgtggttagttctgtaagtggttaagctgctagatgatggaaactagacagtggaggagagaaatgcatttagctatctctaagagatcctattgccatgaggacatatactgtcaaagggtcatcctagcacaccagagaagtgacatttcagctgagtcagttgtgtagagacttggggaaagatcctgacacatttggatta

SEQ ID NO: 14850 - DNA, 385 bp, Homo sapiens
tttttgtagagacagggttttgctatgttgtccaggctggaatctctggacttttcagagaataaacccatgtaattttaagcctcccacaacctcctggggtatttattaaatgcagattctagcagtccaggaatcttttttttttttttttaacaggatcttgctctgtcacttaggctggagtgctggagtgcagtggcatgatcttgactcactgcaatctctgcctcctgtgttcaagcaattctcctgcctcagtctcccaaatagctgggattataggcatgcaccaccacagcctgagtaatttttgtatttttagtagagatggggtttcaccatattggccaggctggtcttgaactcctgacctcaggtgatc

SEQ ID NO: 14851 - DNA, 516 bp, Homo sapiens
cctcagcctcccaaagtgctgggattacaggtgtgtgccactgtgcctggctgtaggcttgttttatgagtctgggagtaaaatacttcttaaaattgtccaattagaatgaaagtctgttttaatgtttttatgcagtttagcttaggtggaataaactgcatgaaaacattaaaccttttccataggtcaggcagccattgtactaaagttcatgaaccctttcattttcccttcacaagataaaaaacaagggaccgcaactttgagggaaatctagaaaggtaggagactggactttggagttgtcagattaggacaggtgaaaagcagatattctaggctcctaaaataatgtgggaacaggcccagagcaactttggacatggtgtgtttgggtgcactggatgcttttcttttgagaaggaagctccatgaagtacagactcatgggcagagtttgagtgaaggtagtcggtagtctggtctagaaattggtgaattagctggcttggg

SEQ ID NO: 14852 - DNA, 455 bp, Homo sapiens
gtaggatgatgggatatggggagaacagaaagtggttttatgcctgctctcctttccttcctcaggtttaggtattgattgggaaagggctgccaggagctcagtttctttgagaaacagcattaggaaacttgttgttgttgttaatttaatttttttatttcttacatgtcacagcttttgataatctgatatctctactgacctgttatagtagtcatggacaaaattagacctgtatagtagaatcaactaggaagaatggccatatgtgtttattagatttggggagccttccactgcagacttcatttgctggtgaaagtatcaccaccttaacccagagcttgccattcaggtttttttcccttcaactgtctttacattttaatgacagcaccataagggtctgttcttagagcaggaatatcaatataatcttcatttcattcttg

SEQ ID NO: 14853 - DNA, 278 bp, Homo sapiens
ggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacag

SEQ ID NO: 14854 - DNA, 212 bp, Homo sapiens
ggcagctgctgtgaagcgggatatggacctggtgggagcagacagcagcgtgggcagggctgcagtggcaggtgggccctgtgagaacacgcactcggatgcactggcagctgctaaggctttcgggagcagctgtttggccttggtgtcacccacatttcacacaggtaccaggggttatgcgtggggacactgctggctctccggctgct

SEQ ID NO: 14855 - DNA, 774 bp, Homo sapiens
ggcaggtattattagccctatgacttgccgagctatacagcaagtaaaggtagactcaggaatgaaaacccagactcctggcttcttgtcagtgttctgcccatggctctcatcactagaccatatttcctaattcatatttggaaagtcactaataaaattaatggtaggaactgtaactcacaacatcatacattattataatttatacattcatatcttaaagaccattttggttttcgtgttaaaacacataggtaattggatttcacattttggttgcattcatttttcgcccccctcaacctttacaggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatatatagaataaaacctggagaaaacgcaacacaacaaaacaacggacaaaacgcacacacagagagatcaaagagagcgagtacacaatgaacagcaccaaaagacaaaaagcgaagacaaaacaacctcgaaggacaaataaagaaa

SEQ ID NO: 14856 - DNA, 553 bp, Homo sapiens
ccctttcaaatgccataggtgttattgactagtaccatataatcgcctttaattcttaaactagttcacgtcatacattttaattatcctagtctctgtaattgatatttatcatgaagattgcattgctcttatttcagaaaaatatgttgagaaactttttggagtaaacaaagatcgaatgtcaatggaccagatggctgttctccttgttagcaatatcaatgaaagtaaaggtcatagtaagcacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgt

SEQ ID NO: 14857 - DNA, 5997 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggtaagaaaaacttaacattcttttggtcctctgcctaatggaataggctctttatataagattattcttgaaaacttgataaaaatagtctgttgttccactatgtcctcatgaatatatactgcttaatttcagagttgttaagccaatatttagctattcattcaaaagtcagtgtaaaaattctggtcgcttcagaaaacttcaggttacaaaggggcaaataattccattcaagtaaagttcatctgtgttccctaaacacacaccatctgtccttagcatgtgcattataagcagtaagcttgttttccacggcaagggaatattatttaagatgttttcatattttcacctaggtcagttgctctcaaatattggcaaacattagaatctcctgggatgctcatttaaaatgtagattcctgaccttgagccctcacactacatttttgaagcactgattagggatttcatatattcgatcagaacgagatttctcagcctttctttgtagtttctctgctctgatacagcaaatccactttcatccgcaagaattatgctttttaattcaaaaaggtaccctgcatgctaatgcactggcttccacgtttgcagtcattcccactgcatcagttgtatcttaatgttttatggatcataagatgcctaaaatatttatgaaatgttcccttatgttttaaaggatttacatttcatttagcatgtatgtggggaaaatcgtataaaagtttaaaaactaaagttgagacaaacataatggtagtattttacagttttcttagcaagcctgccaatctgtagaagctcattacagaaatgttaattatgaaacacctttgataaaacgtgaaatagaaaatgtcatattttgacatgattttctattgtgataggcattttagaatataggtagtttacttgtttattttgttggtaaatccctacatctgtgttttgatacttatttcctctggtcatccctgttctttttttccaggagaataaagaactttaatagttactatacatgcattttagttcaagaaacattcaagactgatcatactctaagaaagaaaaataccaggaaattgcattactatcaagccattactttaaaaaaaaattggggtgggaaacagggactgttatttggcgggaatgctttcatgtcctatagaaatacatggaccttagtgtagtttggtaagatgagcatagatcttgacttgacctcttcgtagtttgcacattcctgtcccagggtaatttttgtaagaggcattctaaaatatttgctgggtagtcttgatggaatttaactaatcaaaatttatacttcgtcattgtgctcatagagcacatttggggttcgttacacttgcaatgctttgttcattttcctgaatgtactttacaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14858 - DNA, 4550 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14859 - DNA, 3433 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14860 - DNA, 4121 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14861 - DNA, 4492 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14862 - DNA, 4495 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctctggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14863 - DNA, 2618 bp, Homo sapiens
ggcaggtattattagccctatgacttgccgagctatacagcaagtaaaggtagactcaggaatgaaaacccagactcctggcttcttgtcagtgttctgcccatggctctcatcactagaccatatttcctaattcatatttggaaagtcactaataaaattaatggtaggaactgtaactcacaacatcatacattattataatttatacattcatatcttaaagaccattttggttttcgtgttaaaacacataggtaattggatttcacattttggttgcattcatttttcgcccccctcaacctttacaggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14864 - DNA, 4753 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaactcttgctgtctttattcacttttcacactggtgggaaagggttgaagtcggagatacggatattcaccataacttatagcaatacttttttatcttgaaactgctttcccattaaa

SEQ ID NO: 14865 - DNA, 903 bp, Homo sapiens
catttaacttgttttaatgggtctcgggagttctgtgagcgagtgtgtgttggtcaaggttgtttgccagggtgggaagtagcgtgattttaaaaactaataacttaaaactgccacacgcaaaaaagaaaaccaaagtggtccacttacattctcctttccttctgaaggttttacgatgcattgttatcatgaaccagtcttttactactaaacttaaatggccaattgaaacaaacctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaa

SEQ ID NO: 14866 - DNA, 4740 bp, Homo sapiens
  misc_feature (4573)..(4573): n is a, c, g, or t
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtttttcattatattttctgatggaattgtgtgtatatctatcttacaggtccaccgtttatatcagagagccttacagaagttacctctttgtgcatcactgtggaaagatgtaatgctttttatcttttattttatctcgatgttttcctgtaaattttctgcatgtgccatatccattgatgtggtaatgctcaaactctagctaagtcttacttctatgcttccctgtcttttacagcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaactatagcagtccatcttaaggaaagtgtaactgccatggccacaagtctgctagttgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaaaaaaaaaaaacaaaaaaaaaaanaaaaaaacaaaaaaaaaaacaaacaaacaaaaaaaaaacaaaaaaaaaaaacaaacagcacaaacacaaaacaaaaaacacaaaaacgggggacacgacaacaaaaaacacaaacaaaacaaaactggtggggggccgcccgcgcacgcgagaagagtacttacccg

SEQ ID NO: 14867 - DNA, 3582 bp, Homo sapiens
tgtattcaaaagctgacagcctaaaacagctgattttaaaaaccaccacaggcattacagagaaggttttgcatggtcaggagatttctgtagatgtggattttgtcacagcacaaagtaaaacaatggaagtgaagccatgtccttttagaccctaccatagtcctcttctagtttttaagtcctacagatttagtccatattatcgaaccaaggaaaaacttcccctgagctcagtatcatacagtaatatgattgaaccggatcagtgtttctgccgttttgatttaacaggaacatgtaatgatgatgattgtcaatggcagcatatacaagactatacacttagccgaaaacagttattccaggacattctgtcatataatctgtctttgattggttgtgcagagacaagtactaatgaagaaattactgcttcagcagaaaaatatgttgagaaactttttggagtaaacaaagatcgaatgtcaatggaccagatggctgttctccttgttagcaatatcaatgaaagtaaaggtcatactcctccatttacaacctacaaagataaaagaaagtggaagccaaagttttggagaaaacctatttcagataatagcttcagtagtgatgaggaacagtctacaggaccaattaagtatgctttccagccagagaaccaaataaatgttccagctctggatacagttgtcactccagatgatgtcagatactttacaaatgagactgatgacatcgctaatttagaagcaagtgtgcttgaaaatccttctcatgtacaactttggctcaagcttgcgtacaagtacttgaatcaaaatgagggggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggacttttctacacctagaaagtacctttgaagaaaaggattacgtatgtgagagaatgttggagtttctgatgggagcagccaagcaggaaacatccaatattttgtcctttcagcttttagaggctcttttgtttagagttcagctgcacatatttactggaagatgccaaagtgcactggcaattttacagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaagatgcagtgaaagcttgcacagatgagagccttgctgttgaggaaagaatagaggcctgccttccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatatggatggattatcttgtctttgcaaataatagagctgctggatccagaaacaaagttcaagaattcaaattttttactgatttagtgaatagatgtttggttacagtccctgcccgataccccattccttttagcagtgctgattactggtccaactatgaatttcataatagggttattttcttttatttgagctgtgttccaaagacccagcattccaaaaccttggaacggttttgttcagttatgccagctaattctggacttgcattgaggttacttcaacatgaatgggaagaaagcaatgttcagattctgaaacttcaagccaagatgtttacatataatatcccaacatgcctggccacctggaaaatagccattgctgctgagattgttctaaagggacaaagagaggtccaccgtttatatcagagagccttacagaagttacctctttgtgcatcactgtggaaagatcaactcttgtttgaagcatcagaaggaggtaaaactgataacctgagaaaactagtttccaagtgccaagagattggagtcagcctaaatgagctcttaaatttaaacagtaacaaaacagaaagcaagaatcactgaacactgggtgcagtcagttctaagtccttataataattgccaaaattatttgaatgattcttcaagattaggctgatccctggctaaggtctgtgtaaggcagacaagcgttattgatcatatcaagttccctacaatatcctgtcctcaaaaccggaagcaatgaacatgatcctcttcggttggataaatgaacttcctgtttggcctgcttctaggccctgccagattctcataacatcatatacgtaagtatagttcctcaaagtgactgacatttattttaattttgctttgtttttttttattttctcccccattcctttattttgtgttattcctgactcacttgacactctctgatgcctgagagattcctgtttgggatttaatatccagggctgtgtttacagtaaaaaaagcaggcagtcccttttagtttttcctttttaaatttttttgagattcttcatttcaggatttaaaattgcacttgaatgctctatcagggttgtttattaccctttctacgttctggactccttgccgagactgtttaacttgaagattaaagaaactattgcaaatgccagtgcatcagaacctaagagtggtcaaatattatgtgcaatttttttgtaaagaaattttaatttataataaagtttaacagtttaaagaacagttaatatttgaactgctttgtattgaaatactactttgtagtattgaaattgtttatatacttttttaatataagttaactttctaaaaactcttgctgtctttattcacttttcacactggtgggaaagggttgaagtcggagatacggatattcaccataacttatagcaatacttttttatcttgaaactgctttcccattaaa

SEQ ID NO: 14868 - DNA, 611 bp, Homo sapiens
gcggtcctcctgcctcagcctcccaagtagctgggactacaggcatgcaccaccgtgcctggctaaattttgtatttttagtacagatggggtttcaccatattggccaggctggtctcaaactcacgtgatccacccaccttggcctccctaagtgctgggattacaggcatgagccatcgcgtccagcacatttctaatacaaatctattctcaaaacttttatacagtcacacacctaagcaacacaaattgtatgtgataataaatgtgtacttttggatattcatcatgatcttgctgcgatttaccttttaagtcagggaaaagagaaatgaaattgcttcagtgatatctctaagagtatatctgtattgttttagttttcatctgattccacttttcgatatgtgatagaagagggagtctaggttgtagtactagaagatggagttatacatttttacagtaatcctttttgcagaagttgaagatttactatgagatggtttcttaatgaaatgtgaaaagtctgtagttttggtttattcctgaaaggcaacattaataatataaaggccctttgggcagtttctacacctagaaagtac

SEQ ID NO: 14869 - DNA, 322 bp, Homo sapiens
atgggtgtggtttaaaagattttttttctttttactgttttgtctttgtcttattagattttaagtatcaggacacttaaaatgtacaaataaatgtgacctttttattatttcataaactttagcatagtaaaaattatgttaatctggtactgacatctctaatttttttatcaaaaaattttaaattttgcctagaatgcattgaaatctgctaatgatggaatagtagctgaataccttaaaaccagtgatcgatgtttggcatggttggcctacatacatcttattgaattcaacattctcccttcaaaattttatg

SEQ ID NO: 14870 - DNA, 4594 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgta

SEQ ID NO: 14871 - DNA, 656 bp, Homo sapiens
aaagtgctgggattaccggtgtgagaccttacaggactgttagtctcaaactatttttttaaaaataccaaaattttaaagtccaaaattacagatcactttaaagcagtactatgactagtttaacatcaaacagctttccgttggaatattgttcctttgttctctttatctaccattttaagcatgtgattttaaactttttttttttttaattctaagcttagttgacaatttaagaagctagtattttttggaaatcgtcccaaactttgaaaagaaaattctgggcttactgctctggttgggaactggattttttccaacccatcttccataggctcggtcaagataaagcagaaacattaaaagcaagagcaggaaaactagtataaaaacttagcaccaagtaggccagaaccagatagcaccacctttatcttttcactcttttgacattcctaattttgtttttcacaggatctggtgaaaagccatttgatgtatgcagtaagagaagaagtggaagttttaaaggaacaaataaaagaattagttgaaagaaactctttacttgaacgagtgcctgttacatcccttccaagcatggatcattttccaattcccccgggcatccggtagccttctcacagcgc

SEQ ID NO: 14872 - DNA, 5055 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14873 - DNA, 4983 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14874 - DNA, 5212 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14875 - DNA, 4931 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14876 - DNA, 5161 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaattgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14877 - DNA, 2395 bp, Homo sapiens
aaagtgctgggattaccggtgtgagaccttacaggactgttagtctcaaactatttttttaaaaataccaaaattttaaagtccaaaattacagatcactttaaagcagtactatgactagtttaacatcaaacagctttccgttggaatattgttcctttgttctctttatctaccattttaagcatgtgattttaaactttttttttttttaattctaagcttagttgacaatttaagaagctagtattttttggaaatcgtcccaaactttgaaaagaaaattctgggcttactgctctggttgggaactggattttttccaacccatcttccataggctcggtcaagataaagcagaaacattaaaagcaagagcaggaaaactagtataaaaacttagcaccaagtaggccagaaccagatagcaccacctttatcttttcactcttttgacattcctaattttgtttttcacaggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14878 - DNA, 1735 bp, Homo sapiens
gtgctgtggtgatctagaggatccaaatcctctcttcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14879 - DNA, 4601 bp, Homo sapiens
  misc_feature (4434)..(4434): n is a, c, g, or t
  misc_feature (4447)..(4447): n is a, c, g, or t
  misc_feature (4459)..(4459): n is a, c, g, or t
  misc_feature (4468)..(4468): n is a, c, g, or t
  misc_feature (4493)..(4493): n is a, c, g, or t
  misc_feature (4515)..(4515): n is a, c, g, or t
  misc_feature (4523)..(4523): n is a, c, g, or t
  misc_feature (4561)..(4561): n is a, c, g, or t
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaatgggtttgggttttttttgntggtttttttttngttttttttttnttttttttnttttttttttttttttttttttttntttttttttttttttttttttntttttttntttttttttttttttttttttttttttttttttttttntttttttttttttttttttttttttttttttttttttttt

SEQ ID NO: 14880 - DNA, 1496 bp, Homo sapiens
gtatcaacgcagagtgcccattacggccgggagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14881 - DNA, 3188 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatgcttaaaagaatggtgtgtgctgggtgaaagacaaagactaaagaatgaggaaacaaacgtgatgcatatgagctgaagatcgccacatagctcttcggagataagacgtatcgagttaca

SEQ ID NO: 14882 - DNA, 248 bp, Homo sapiens
ctataaaagatttttaaaggctatttgattaaaacatttatttacttaaactctttgctagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattggtaagacttaatggcttagattttatgtat

SEQ ID NO: 14883 - DNA, 4421 bp, Homo sapiens
agtcgtacttctcgtatctgtcgaacaaggtcagtgctgaggtagagccctagaggaatatggttgcagacattttgtatcatgttaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14884 - DNA, 4929 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaattaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14885 - DNA, 2100 bp, Homo sapiens
gatccttcgatgtcggctcttcctatcattgtgaagcagattccctggcaaacccccttcagttaacacctatgaacagtctggccacctctgtattcagcatagctattcctgttgatggtgatgaagacagtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggttttttttttgttgttttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttggactcaatattcatattat

SEQ ID NO: 14886 - DNA, 4494 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgctattttcataatgtacatgaacaatgtcacagaacttttttaatttttttgaataattataagtatcagtaaaggaagtgaaagacaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaaactgattgggatcctctagaaca

SEQ ID NO: 14887 - DNA, 4054 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggatagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattgtgcatctgggggaggtgttgtagccattgacaacaaaatagaacaagcaatggatctggtgaaaagccatttgatgtatgcagtaagagaagaagtggaagttttaaaggaacaaataaaagaattagttgaaagaaactctttacttgaacgagaaaatgcactgttaaaatctctttcaagcaatgatcaattatcccaactcccaacccaacaggccaatcctggtagcacttctcaacagcaagcagtgatagcacagcctccgcagccaacgcaacctccacagcagccgaatgtctcctcagcataaagctttcttaagcctcattaagaaaaaaactgaaagcaatctatccttgtgtgccactggtgttctttccactttatacgaaagcaagtagccatgctttggttgtgtgtttggccttttcagtattagacaatcattctacaagagcttttcctctctctgagatgtcatgcagcgctgttgatgtccagttctatgtcatcagtacacaaggagaataatagatggggtttattaaagcgagcaaagtctgcattttacctggtgcgcatgagtggggtctttaagagttttggtggctctcccatgtttcctattacccatggatttaccctgagccttcctatcacattataaataacagttcatctaaagagccacttttctttctgattcagtaacatttgcctacataagttttcatttatttgtgttttatttattacagggctgcggagaggatttgggatcctgagagtcgaccgcagcagcgcct

SEQ ID NO: 14888 - DNA, 3318 bp, Homo sapiens
attttagtcggcagcggcggcggcagcggggctgctgctcctcccagcatccctggcgcggccatttcagccccatcttggcccagcggagggagctgcagccgccgcttcagcagtttgaatttcagtttcttcggggtttaggaattgggcgcaccgaggaggagccggagaagccaccaccgctacctcacacagccggggcgcctccggtcccgtgccagcggtctgccgccgccgcccctctctgagagaagccgcgaggggaggccgagaccgccgtcgccgcccgcccgcaggggtggttccccctgtaaggggaggaccgagccggctttcccctcccccagagcgggtttccgcctgaggcagtcgacatgtccctggggctgagctccggctagagccggggagggagggccgcctgcccgcgccacagccccaccgcccgcccgcggaccttcagccagctccggcccgcggctcccggctgaattaggcatctccgactccggactcgccgctccttccctcagtcagagagcccagcgctgacgccggcaccggcctgaggagcccgagcggggcagcaccgcccctcacgccgccgccaccgcctcctcctcctcctcttcgccctcccactcccacccccagccaaggcctgctgaccgcgccgagcgccgagctggactgaccacggctgcccggagacgagagaggaagcagccggcccgcccctgggttcgcgctctcgccgcctctgagggaattgaattgaggcgccgcggctgcgagagctaaaaaggaaggaggagccgccgcgggactgagacgggggcagagccgaagagaccgacacagagaaggaaacgaggaggaggatgtctcaccgggcggccagcgcctggatcagcccgtgactcttaacagcggcgggcctcagaccccagcgcagactcggactttgtctttgggggcccgtgctctgccctccccggtttccgacaggacccagaggagccggcgtgcctctctgccctccagccttcttcaccatgtccaagatgccggccaagaagaagagctgcttccagatcaccagtgtcaccacggcccaggtggccactagcatcaccgaggacaccgagagcttggacgacccggacgagtcacgcacagaggacgtctcctccgagattttcgacgtctctcgggccacggattatggccctgaggaggtctgcgagcgcagctcttccgaagagacgcttaacaatgttggggatgcggagactcccgggaccgtctccccaaacctcctcctagatgggcagctggcagcggcggctgctgctcccgccaacggaggaggagtcgtttcggcccggagcgtgtctggggcgctcgccagtaccctggcggcggctgccacttcggcccccgcccccggagcacccggcggcccccagctcgcgggctcatccgccgggccagtgactgcagccccatctcagcctcccaccacatgtagttcccgttttcgcgtgatcaagctggaccacgggagcggagagccctatagacgcggccgatggacgtgtatggaatactatgagagggattcagacagcagcgtcctgactagatccggggattgcattagacacagcagtacttttgaccagactgcggagcgggacagcggcctgggcgccaccggagggtcggtggtggtagtagtggcctccatgcagggggcgcacgggcccgagtcgggaactgacagctccttgactgctgtgtcacagctacccccgtcggagaaaatgagccagcccactccggcccagccgcagagttttagcgttgggcagccacagccgccgccgccacccgtaggtggggctgtggctcaaagctcggctccgctgccgccgttcccgggagccgcgaccgggccgcagccaatgatggcagccgcgcagcccagccagccccagggagcggggcccgggggacagactctgccgccgacgaatgtaaccctggcgcagccggctatgtccctgcctccgcagccgggccctgcagtgggcgcccccgcggcgcagcagccccagcagttcgcgtatcctcagcctcagataccgcccggacatttgctgcccgtccagccctccggccagagtgagtacctgcagcagcacgtggccggcctgcagccgccaagccccgcgcagccctcgtccaccggcgccgcagcgagccccgccacggcggccacccttcccgtgggcaccggccagaatgcttcctcggtgggcgcgcagctcatgggcgcgtcttcccagcccagcgaagccatggccccccggacgggaccagcgcaaggcgggcaggtcgcgccttgtcagccgactggagtgcccccggctactgtgggaggcgtggtgcagccgtgcctcggtcctgccggggctgggcagccccagtccgtgcctccgccgcagatgggtggcagtggtccgctgtcagccgtacctggtggccctcacgccgtggtgcccggagttccaaacgtgcctgcagccgtgcccgctccaagcgtgcctagtgtgtctaccacttctgttactatgccaaatgtacccgcgcctctggcccagtcgcaacagctgagcagccatacgccagtcagcaggagcagcagcataatccagcatgttgggctgcccttagcgccaggcacacacagcgcaccaacaagtctaccacagtctgacctaagccagtttcaaactcagacccagcctttagtcgggcaagtcgacgatactagaagaaaatcagaacccctacctcaaccaccactttctctcattgctgaaaataagcctgttgtgaagccgcctgttgcagattccctggcaaacccccttcagttaacacctatgaacagtctggccacctctgtattcagcatagctattcctgttgatggtgatgaagacaggaatccttcaactgctttctaccaagcgttccatttgaacacgttaaaggaatcaaagagcctctgggataggggggaaatcacatggtatctagcatgggacaaagcagcaaaataaaccaaaaggacaatctctattttatatagaaaataaacatacttttctgcatcctgtgtactttaagtatatctatatttttgaagggttcatactgtgttgaatttttcttatgaaatagtcacttccccagtgtattttaatgcaaatgcatattctataaaataaactatattttaatttt

SEQ ID NO: 14889 - DNA, 416 bp, Homo sapiens
gagatgtcccagctgagggaatctcccagaatgaaaatggactaactgaactgtggctgcatagtcttcaggctactgagaaaacaatacaacaaaaaaccacacacaatgactcaaactttatagaggggaaaggtaatagtgcatcacaagtttaacatccttgagtatacatccttttacttaacttttgtttctagtaacaaagttatgacattgcaagtacatcactggaatgcatctactagcagaaatgtttattgtacaccatttttataggaagtactgcctcagcttacgagctttgcaaacaaatattagtgctaaatgctttttactgacatcttcgtttctgaacagaagctgataaaggtactatttttctgtcaaacatgaaatggattttccatgttgat

SEQ ID NO: 14890 - DNA, 343 bp, Homo sapiens
ggcagggacagacttgaatctaggtttgctggactcagaagccaattctcttggtatctctctggactacagcaacatatggttcactttcggagcccacagctcttgatgtgagctgcagttctgagggtcctaccctacaactgtcatgtgattacaccatactgaaaaagtgcactgggggtctcataagaatattttctgccataagaggaaagttatttaccccttgttgcagcctttatcatggacatgaaaatgctaaaaaatatttagggtcttctaatcagtaacttctattgtgaaagacaggaaaaactggctctttcccaaacgatgttgc

SEQ ID NO: 14891 - DNA, 1004 bp, Homo sapiens
ctttgaaacacaaaaatttttaattttgaggagatccagtttattttttgtttggcttgttctttttatgtcatatctaagaaaccattgcctaatccaaggttacaaagatttatggctatgttttctcctcatttttatagtattagctcttaggtttatgtttttgatccatttgagttaatttttatccatggtgtgagataggggtgggccagtaaactttctctatgaagggcttcacgctgctgatgaagacatacccaacactgggcaatttacaaaagaaagaggtttattggacttacatctccatgtggctggggaggcctcacaatcatggtggaaggtgaaagccatgtctcaaatggcagcagatgcaagaggagagactgtgcagggaaatctccctttttaaaaccatcagatcccttgagacttactatcacgagaacagaatagcacgagaaagacctgcccctgtgattcagttacctcccaccgcgtccctcccacaacatgtggaaattcaagatgacatttgggtggtgacacagccaaaccatatcaaaggaccatatagtcaatattctatcctttgtggggcatgtgatctctgttacaaatattgagctcttctgttgtgacaggaaaatagccatggacagtaaatgaacaaatggatgtggctgtgttcaaacaaaactttatatacgaaaatagatggcaggccagatgtgaccccttttttgccagcccctgttctaggatagctgagtaacctgaacataactggagatttatggtcacggtatttgccttatgtaggttttttgctcaaatgtttaatagtatacacaccagtgagtaataaacttatgtagttcttagcatttgaaatgctttaaacatcctggtaaactttgctttaatactgctttttacagatgatagacttgggtcattcattaaattgaattaaattagaatactaaacaagcctt

SEQ ID NO: 14892 - DNA, 381 bp, Homo sapiens
gatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatc

SEQ ID NO: 14893 - DNA, 565 bp, Homo sapiens
aagaagctcccaggtgaagactctcctgctggtccagatttttattcaatacttctggtgttcaactaaagaaactattttaattagcacgtggatgaatgagacttcttgtgaatctacccaggagttgctttttccttgcaataccaggtcatcagcacaattgatgaacatgaatggaggcatctgacaactcctctgcaggtggtgattcttgcaaatgagatgttactaatttgaaccaattggagggactgtaattgagattctattagtgatctgcccacaaactgaatgagctattctgttattaacaaagaaaggaagaaattgaccttcaaattgggttcattttggactgtaaggtagaatgtcattcaactaaatgctcattattcccgatctttagatgaaagatgactttcccaaaaagatatgaaaaaaatgttatgctaatttcacatgttgagcaatgggtaatgctaagatgtcaaaatgtctctggaataggaaagtaactaatgtgtacactagaaatattgcaaataaaagagatcggccagag

SEQ ID NO: 14894 - DNA, 710 bp, Homo sapiens
accccttggtggtggctggaatgagcaggtaaacaccatcccagatgaaccgaggcatgttctatagcagaatatagacaagcatcttttgcatatgacagtgtccagggtaccctcgttcttccccgggcacactgcaagagcttgggaaccgctgaacatgggtgcaagctataacacagatttttattcaatacttctggtgttcaactaaagaaactattttaattagcacgtggatgaatgagacttcttgtgaatctacccaggagttgctttttccttgcaataccaggtcatcagcacaattgatgaacatgaatggaggcatctgacaactcctctgcaggtggtgattcttgcaaatgagatgttactaatttgaaccaattggagggactgtaattgagattctattagtgatctgcccacaaactgaatgagctattctgttattaacaaagaaaggaagaaattgaccttcaaattgggttcattttggactgtaaggtagaatgtcattcaactaaatgctcattattcccgatctttagatgaaagatgactttcccaaaaagatatgaaaaaaatgttatgctaatttcacatgttgagcaatgggtaatgctaagatgtcaaaatgtctctggaataggaaagtaactaatgtgtacactagaaatattgcaaataaaagagatcggccagag

SEQ ID NO: 14895 - DNA, 251 bp, Homo sapiens
ctttctgatctacagttcaatacagaaacaatgtattgatgttaaagattaaaatttactggctgaattttcacaaaaacttttgcatagttggagaattaggttgaaaaattagtgtcgtatttcagtaagcatggccaatcatgtgtcttccattttgatcttcttactttttcaagtataacaatatttaataccagatattaaaatgaatgcatttagaagatattcgaaagaatgaagcatgtgca

SEQ ID NO: 14896 - DNA, 318 bp, Homo sapiens
aaatcgcagaagtgatggcatcagaacttcaacagccttcttaaattggatgtcattaaataaagcaggccatcgcgcttttttagtttgacttctgtgatagattttcagttcctagcctgcgtgaaaaaacactgtaagtttaatagatgtggctataacatgcagacaataaggaatgttgtgaaaatgcaaagttagttacttcttgaggatcaatgtgtagatttagcacgttaacttgtatttcgcaaccatgttctgacaccgtataataatgatttctaattagaaatagatgtgcttatgttaacatgc

SEQ ID NO: 14897 - DNA, 219 bp, Homo sapiens
tcagactaggtaacagaccctgttactgggagggctctataggtatcgattgtttccacatatgaaatacacagcctttgtctctttggtgagcttatcatatgtgttttagtaaaaaagttcttcttaatcaaacaatttgtacacttgatttgtcaaactatattctggttaaagaaaaggccgattcttagttatttatccagttatctgccattg

SEQ ID NO: 14898 - DNA, 813 bp, Homo sapiens
cgagataaataaaaatgataagtaaccacccaggttactaccacccaactggtaggcagaaatggcccaagtcatgaagtcacatgactaaataaagcttgggaaatactagcataaagttaattcatgtaaacactaatgatcacaggcacagtatccttggcttctgtttcttcgtggcgtgtgtccacatgagccggcctgaatcataaagcccagcctgaaagcagctctctttctcggaagggctgatgtcatttgtgtgtgttttatcagctgctcttcaaggagcataactcctgtggcttctgccatatctttatgccatcagaattctgatttcgggaagacctcaagagagcattgaaatagctcacttacagtcctcaccccttttggcatcaagggctcacctctgctccctcacctccttggacctggtactccagccaacatggatcggtaaatatacataatgatggaatattagcctgaaaaaggaaagtcatacacaggctacaacatggaagaaccttgaaaacattatgaaactgaatgattccacattgttcaggatgtgcctagaccgatcagattcatagagacagaaagtagaagggtaattgtgggggctgaggagggataatggggagagttagtgtttaatgggtacagggtttcagtttgggaagatgaaacagttctagagatggatggtgccgatgaatagcgagggctaggaaagataggtgccgatgaatagcaggtgccgatgatagcgacgtgccgatgaaagcgaggtccgagctgata

SEQ ID NO: 14899 - DNA, 445 bp, Homo sapiens
gggagagttagtgtttaatgggtacagggtttcagtttgggaagatgaaacagttctagagatggatggtgccaaaggttcccaatagtgtgaatgtacctaatgccactgaactgtacgttaatcatggctaaaatggtcaatgttggctgggtgcggtggctcacacctgtaatcccagcactttgggaggcagaggcagggagatcacatgaggtcaggagttcgaggccagccttgccaacatggcaaaaccccgtctccactaaaaatacaaaaattagccaggtgtggtggtgcacatttgtgctcctagctatttgggaggctgagacacaagaatcgtgtaaacccgggagccagagtttgcagtgagccgagattgtagcactgcactccagcctgggtaacagagtaagactccatctcaaaaaataaaataaaa

SEQ ID NO: 14900 - DNA, 442 bp, Homo sapiens
ttttttttttgggtgtattttttgtatttttagagacaagagttcaccatgttggccaggctggtctcgaactcctggcctcaagtgatccactcgcctcggccctgcaaagtgctgggattacaggcatgagccactgtgcccagccaagggagttgaagccttaaaggaaagacccaggaaaacagatatagggtccaaaaggcagaaaaggattctaggggttgtaaacacccaggtaaccctggtgaaaggctttgttgcctccagatggtgggacaggagttccaccgcaggcaggattaggtggtattttcattcatttctttttaggttaatacattggcttagggacaggatcctattccagggctgaaggggatcttgagaatcaacttgcccaatgctctcattttgtaggtagaatctacagctcagagaa

SEQ ID NO: 14901 - DNA, 368 bp, Homo sapiens
cctctggggctcggggctcaggcctcagctggagctctggcctggggcctttgcacggcggctgctgccatctgctcctccctggcgctgtggggccagctcctttcttcgagttctctcactggacgcattgccacctcacacgggacccctgaccctgagctggccgggtggggccaagtgaccccagcacccaggaagtgggcccccgcccagaagctgctgtttgtttcttactagcacctaataagttggaatgtacttcgcaaagccgtggctttcgttgactgtcgacttgttcaacaccgcatcccaggtctgtctgtgctcaaagaagagtgagtgcctgaccagaggcgaccggggca

SEQ ID NO: 14902 - DNA, 383 bp, Homo sapiens
tttttttttctttagtctggctgaaattttttcacttttgtttatctttcccccaaaaaccttctttacttgcttttgtgttgtctttgtttgtttcaatcccatttacttctgctctgatatttattatttattttcttctactaagattgagtttggttgcccttgcatttctacttctttaagatgaatcattaggttgttttttggaagttgtacttttgatgaaggcatttattgttctaagcttccctctcactactgtttttgcagtgtcatattggttttggtatgttgcgtgtccattttcatttgtttctagaattgaaaaaacttccttcttaacttctccaatgacccagtggtcattcaggagaataatg

SEQ ID NO: 14903 - DNA, 383 bp, Homo sapiens
gtatcttctctcatactgattcttgtttgtatctttacccaaaataggagtacacctttgtcatttaattaattgtttgatataatcttccaaaatatggtatctggcagaggggggtgggagagaggaagaatagcacaaggctttgttgggtgcctgctgctggttgtatttgagatccaaatcaactattttgtatgaaatcgtagctattttttcctgtagcttttttttttttggtctctgtgccattggttgcttggatcaggaaatgccctatatttttgtctatattgtcatttaattccttttttcattgcctccttgactagatggtgagatacttgacatggggacctttacctcatcaggttttcattagt

SEQ ID NO: 14904 - DNA, 485 bp, Homo sapiens
  misc_feature (223)..(223): n is a, c, g, or t
  misc_feature (226)..(226): n is a, c, g, or t
  misc_feature (230)..(230): n is a, c, g, or t
  misc_feature (240)..(240): n is a, c, g, or t
  misc_feature (351)..(351): n is a, c, g, or t
  misc_feature (353)..(353): n is a, c, g, or t
  misc_feature (377)..(377): n is a, c, g, or t
  misc_feature (379)..(379): n is a, c, g, or t
  misc_feature (393)..(393): n is a, c, g, or t
  misc_feature (396)..(396): n is a, c, g, or t
  misc_feature (408)..(408): n is a, c, g, or t
  misc_feature (440)..(440): n is a, c, g, or t
  misc_feature (470)..(470): n is a, c, g, or t
ccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccagggaagagcgttcgcgnagnaacnaaactttagntgaacatccagaagacccatgagcggatgcaggacagagaacaagatttctccctattaccggacaaagctgcgtggcctcttacacaaccgccaaggccgatgcagaggntngagtgcaacatccttcgggaaagntntgggacaagatcgnggnaattcaagtctntgtttggaagagaggcggttttcgggccaagntttgccggttttttacattgatttcggggncaccccggtagacct

SEQ ID NO: 14905 - DNA, 342 bp, Homo sapiens
gaactgctgggattacaggcgtgagccactgcgccggccagtttttctatttttagcagagacagggtttcaccatgttgaccaggctggtctcaagctcctgacctcaggtgatcttctcgcttcagcctcccaaagtgctgggattataggtatgagctcccgtgcccagctggaagcaggatttttgacaaatgaattttaatatagaaaaaggccagatactgtgactcatgcctgcagtctcggcagtttgggagaccaaggcaggaggattgcttgaggccaggagttaaaggctacagtgagctatgatcatgccactgcactccagtctaggca

SEQ ID NO: 14906 - DNA, 200 bp, Homo sapiens
gtgttagattttaacatatctctcttggaaaataaaatattaagcactttaaaaaataaagatcaagactatttgactaacacaatagcatgacctaatagaaatattctgaactacgttctaagcagagtatacacattcacaaaaattgaccataagctaaactgcaaaggaaatcttaacacatctccccacccaaa

SEQ ID NO: 14907 - DNA, 273 bp, Homo sapiens
taccctgacagacgtgattgtgaggccacaggacagctttgtcagaatagatcctgtaggaaacacaaactccaaaatgagaaagacaatgatcttggagaactcccaatgggagaggctgttctttgggggctctgccacccagcagtccccccaagtaagcgctaatgctgcagcaaagtgtaagcaaccactacttttgcatttaaaggctagtaagtcagaccctgtatatatgaccataataaacaatttctgtaattttggtaactt

SEQ ID NO: 14908 - DNA, 212 bp, Homo sapiens
gaaaaatatgcaagcagtccttttacttcaagtttctacccacacagggtcaacagagggaggagaggcagaggcagctgccctagaagcagccatcgtcccagtcccatagccagtgtgaaatcttagccctcttttccttacacatggccgtggccgctcttctagtcagcaccgaaatctcctccctgaagagcttctttctcttcctc

SEQ ID NO: 14909 - DNA, 900 bp, Homo sapiens
aatccagaggagacttttaagtgctgttttgtagatgaaatatgaaagagaaacaagggcttaatggtaaagatgacatatgactatattaagaaactgaatggccctttgtccacaaacagtaacccacacagcattgctactgtggcatgcccactgctctgcactgacctcatggagcagagaacctccttcagacacctcacgcaccccctgaggagctaatgtttcttcccaacatggaaaatttggaagaggcctattcttcacagctgtcacttctcattttgaaagaatatgcccacccttattcccaggcaaggtgtgaggaggtctttgggctccagctgttgccagcagaggtggtgaaagtcaacaacagggcactggacacacatagaaatgtgacccacagctatggtttgcaaatacagtctttcaagaagtcctgccatgtcctaaatgcccaaatcccttgcctcccatgattcttctcctcaaaggaccttctgctggacgccgccccctccctctccagccccaccagggccctccccgccatcctcttaggccacagcagccaataaagagtgtttttattccatgatctgtacccccaatgaatccataatcatagtttccaatgtatttaccaaaaatactaacattatctggaatgaatgaatgaatgaatgaatgaataaatattatatatttatacattttcattcttccaaagtgaaccccactatgccagttttactccatactcagtgttctggaaagcccatattctttctaaatttttcagcatttttttctatttttgtactttaccaaaattatttacattggaataaactctcttccttctgaaaaaaaatgtagtaaaaatgtgat

SEQ ID NO: 14910 - DNA, 318 bp, Homo sapiens
caaaaatacctggccaattacctctgcaataattgtgaaactaatttatatatcattgttattaattgtttctatcctcaattataagaatatgaacgtttattttaggaaccaaacttcctcatttggatgggtgattcagttggtcctatgactgacactaacaaaggcaccagaaggcatttttcagagagaatgattggtcctagatggcatctttctcaacagtcagggaattgaccacgaactttcacatccccttctaaagaatgtgtcatctagcctcttagtctgcacttggaaaaaaataaacagaaa

SEQ ID NO: 14911 - DNA, 122 bp, Homo sapiens
aacagggtctcaatctgtcacccaagcttgcacgcaatggcacaattatggctcactgcagcctcacaatcccaggctcaactaatcctgcccctcagtctctcaagtagctgggaccacag

SEQ ID NO: 14912 - DNA, 384 bp, Homo sapiens
tggggagggagcagttggagaggaaagtgtgttgtcgtggctggagaagcaaaatgacagagatatggataaggggggagaccttcgaatgccccagaagtcaatgtaactcctataatatagccctacacagggcctttgctaggtgacgactcatcaggaagcttcttaatatctgttactctgtgcccacctactaggaatgatgataggccttctggacaagttaccattgttattaactcaaaagatccagcaatacaatataaaagctcattaatctacaccttgttaactaataatctgtgatgtgttagacaagctggatatgtttacctatatattgctaagggtagacagaggaaaggagaagactaagttagc

SEQ ID NO: 14913 - DNA, 648 bp, Homo sapiens
ttcaacctgtttttcttcaagcatgagtactttgatttatctggttaagaaattttcagtccttcatactgaggtctcagtcatcttacaatagagacagccagtttactccccactttctagcctccgactcttgaaagcttccaagaaacacatccagaggtcacatattgggcaaccgaaggctcatgtgaaaaagccttagagccacaaaaaccttgcgcctcagtcattaatgtaatttggggcagattttatgaagcaaactaacgcctttgaatttttttttttcagttttaacgtgagtataattacttccactcctttttccactttccagtctctccgagttgcgtccctaaaggatcctgctgcaagaaatgagtgaatgaatgaagatattaagaattaaagtactgatgttaatgagagcatgggtgatgtggtttggattgcttgaggccaggagattgaaactagcctgggcaacatagtgagacaaaccttgtttcaaaaaaaataatatatatatatacacatacacacactaagtgaggtggtgtgtgcttgtagtcctagctgcttggaaggctgagatgggaggattgtgcccaggtgacagagcgagacccagtctgtattaaaaaa

SEQ ID NO: 14914 - DNA, 373 bp, Homo sapiens
taagagcacagtttcatgggactgttgtgaaaaatgagattcttaattgaagagcttagcataatacctaaacttattcccctagattgagttttcatattttatcctcaatgcttggcccattgcttggtgtataaatcatgctcaataaattatctgtggaaaaaataaatgaattaactatacagtaattatttttgtcttaggatttaggagcattaggcccagtgttcggaaagaggatgcagggccagatgtggtggctcacacctgtaatcccagcattttgggaggctgtggcaggaggattgcttgagcctacgagttcaagagcagcctgggcaacatagtgagaccccatctctacaaaaaa

SEQ ID NO: 14915 - DNA, 448 bp, Homo sapiens
ctacctactgagggggtgatggcgctggactggagctgctcagacctcatccggattcatgagtctattctgttttaagagagattttttttttcttttatgagacagagtctgtcacccagtctggagcacagtggtacaatcacagctcactaacatcctcagcctcccaggctcagaagatcctcccacctcaacctcccgagtagctgggactacaggcatgcaccaccgtgcctggctacttttaaatgtttttgtagagatgggtctccatgtgttgtccaggctggtcttgaattcctgggctcaagtgaccctctcacctcagcctctcgaagtgctgggattacaggcgtgagccaccatgcccggacgagatattgctaaagttgaatataagcaaagagggaaaccagaatagggaaaggtctagaaattatgtcag

SEQ ID NO: 14916 - DNA, 131 bp, Homo sapiens
gagaaattctgtatgatcaaaattcacactacaggaagccaaaattaggtataatataataatggatcataactcattgaataaaatgagttgaataaaagaatcaatgagtgcactcaaatataaacaaa

SEQ ID NO: 14917 - DNA, 468 bp, Homo sapiens
gctcagaacccctggctatttctgtaccctcttttctgatctcttgggtagcttctactggtagcaatatcctgctcagcgagtagaaagccctgtctctcatttttcctttggcttcaaagacattgaagtgtgtacatgtgcatgtgtgtgtgtgtgagagagagagagaggggcaggtgtgtcagcaaggggcccgacagatgcaaggtagaaatacactatgcttgcccaggagttcaacaccagcctgggcaacaaggtgaaaccccgtctctacaacaaaatatgaaaatatccttacctccccacaaatccatagccgggcgtggtggcacatgcctgtagtcgcagctactcaggaggctgagatggtaggatcttttgagcccagaaggtcaaggctgtagtgagccaagatctgcaccactgcactctagtctgggtgacagagcgagaccctgtctg

SEQ ID NO: 14918 - DNA, 365 bp, Homo sapiens
acacagtcatccactaatttctgatccattgctttgtccacatgacctagtgtctggttattctttctaaaaaaatgcttataggccaggttcatgggcttctacctataatcctagcactttcagaggttgaggcaggaggatcacttgagtccaggagttcaagactaccctgggcaacatggagagactctgtctctacaaaaaaattaaaaattagctgagcatggtggcattcacctgtagtcccagctacttgggaggccgaggtgggaagatagcttgagcctgggaggtcgaggctgcagtgagccatgactgcatccctgaactccagcctaggtgacagagcaagaccctgtctc

SEQ ID NO: 14919 - DNA, 1003 bp, Homo sapiens
aagcatcagacttctgttaccagacaacttataagtgccaactattggtagaactgtggacatgaagatagtggaaacagcttctctaggatgctatactcatctccaccaaatgcactttgaacaaaaacaacttgtagaaataggtcttaattttttttgtttgtttgtttggtttttttacaacatgctgtactgctctccattggtaagtgctagggaaaatcacttagccactagagggagctataacacaaaattaagcaggaaataatccccattatagatacataggaacaaagtagagaccagctaactaccttgatcctctgtatcagctcttaaagttagatggtttgggtaagttttcttggcaactttacctttgtctttcccatcttttgtgtaaaattcttccccttttcagcttttgcatccatttaggttttcagagtttaccttacaggcactcattttgtaacaaatctaggttctgggactaagaaaatactgaagacataagtctgcttgtttttctgcctaccttgtacatcaggtatggaataataaggccatgaatgtgagaattgggaacaggagttaggtgtgctggggaaaactagacataacaatttggttatgaactagaagaaatgaatatgcttttagagacctgcagtttgcttttatggagtgacagtttcaggtgtgatgatcttctcagtattactaagaggttcttaaagtttgtcttaaaatcctacttatgtgtcagcttagctgttttctattttctaggcctcacttaagtagcaggttgtcttgtgatcaaaaagtcagtagacacagtagttaatgccatattaacagctgaaaattactgaaaatttaacacttttagtatctgtcattcccatcaccgctttctccccaggtttcttttataaaaaatggaaaggacacaaacttgtctcctgtttacagtataaattgtcattgagaa

SEQ ID NO: 14920 - DNA, 438 bp, Homo sapiens
gaacacccctatagtgcaaagaaaaaagggaaatcaaacttcatctttttttccaagattgtcctctgcaaagaaccttcatttcagaaacccagaagttttcaaaacaactgtgggaaagagagatgaatttgcaggccttctgaactctacccacaaactctcaagagaacccacccgctgcagcctgtggctcccaactgtcctgcctacgcccaacagggaactggggatccgtattccagggaaccctctggaaacgtcacactcagttagcagattcttgagggcggtaactatagttttcagatctttgtgtcctctgtacctggaccaggtagagacttgataaatatctgtagttgttaaataaatgaaatgtttatctttgctgatctcttaaaaataaatcagttttacctacttgccatgcaactc

SEQ ID NO: 14921 - DNA, 412 bp, Homo sapiens
aaagattcctcacattatcagtttttcctttttttttctttcattttaagcaagctatagtctagttctggcattctcagggattttttaaaagttcagcaagaatgctgaataagcagcagatgtggatagcagcaagccgtcttctgcttctgatctttcgggtcagcattattttactatcgagccaagcaatgggtctggagagggtggaggtccaccagggcctgtcctgctgagctgaatgcggcaaagtgaaggtgagtgctgttcacctccgtcctggcatctggtgccccagaggaggtggtctgcttctcatttttcacaggggcctgaacaacctgcacccttcactgagtctcagtgtttgcctttgcaaaataggctaacaagaggaagaaaaaagaaa

SEQ ID NO: 14922 - DNA, 332 bp, Homo sapiens
gctgcccagactgtagcaggctgcagtggctggggagaccctactcattcctgtgcccctcctaaccagtcctagatagggctaaagaacgtctataaaccttttcagaagcttccagttgacacattctctctcttctctgaaatcctacaagtgctatctcatgatttacaaagacccaatacatgtgctgtctcattctgtcattgccagtcttaagtcttaagccctttgaggcctgattctacagccgagacatcctctatttctccaccatctctctgtctcattcagagcacacagtatgaatgaggtcaataaacacagtgttt

SEQ ID NO: 14923 - DNA, 396 bp, Homo sapiens
aagagcctataactacactgactcatcattaatacccaaagtccatagtttatgttagagttcactataggtactctacattctatgggtattgagaaatgtataatgacatgcatccaccattgtagtatcatatagaatagtttaccctaaaaatcctctgtgttaatccaattcatcctttcttccccttaattttagcgggggtggggggggatctttttactgtctccatagttttgccttttccagaatgtcatatagttggaatggtacagtatgtatttttttttcagattggtttatttacttagtaatacacatttagggtttttccatgtcttttcatgacttgatagctcatttatttttagcactgtataataattgcattct

SEQ ID NO: 14924 - DNA, 587 bp, Homo sapiens
  misc_feature (21)..(21): n is a, c, g, or t
  misc_feature (30)..(30): n is a, c, g, or t
cggccgccgcccgagctgcanccgccgaancgctttctctgtctcgctcttcctccgccccccgaccacacccccttaaagggccagcccctctacaggcccctctcccctactccgcccccgggcaggggtaggggagggtctattcggcagggggtggcctagctgtccgtactccccaaacgcaaccttccagtcccaaacccaggcgttctaagcgctcaggacgacgatttgcgctcacgccaggaccctagtcttcattggacccttcctcattctgtcctcattgaggccatctgagaataggggctatctgagaatgcaggggagtggacatcgtgtgcagacagggagtctggtgaggagacgctgcggtccccgatgtccaggtcctccagccctcggccagcgaggagcgaacgggctcctccgcacggaccgacacgtggactgggctcctgggaaaggaagagtggagaaggcgggcaggagctgtccgggtccctagactctccgagtagcaggtcccacgcccccagcggaagaagccggggctgggggtgagcggtggcacccggccggcc

SEQ ID NO: 14925 - DNA, 698 bp, Homo sapiens
cagaaagcgggctagcctgcacgcacgccaagatggagctccaggctagcccacagaacagcccagccgcagccgtcctaccagaccagcaccttgtaaccacagtctaacccagcgggcaccaggcgattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaattacaaaaaaaaaaaaaaaaaaaaaaaaaaaacaaaaaaaaaaaaacaaaagaaataaaatacaaacaaaacacagacgaagaaacgaaaagaaaaaaacaaacagcgactgacagaaaacagaacgagcgagacacgaacaacaacacaacagaaacggaccacgaagacgggcggtctgccgccgcgcagcacggatccgccctcagcggcgagggaggcgagcgggtcggcggcagcaggccatccacgcgactacggtcggcccggcgccgggcggcgcgatggcggcgggtcggctgacgagcc

SEQ ID NO: 14926 - DNA, 931 bp, Homo sapiens
  misc_feature (21)..(21): n is a, c, g, or t
  misc_feature (30)..(30): n is a, c, g, or t
cggccgccgcccgagctgcanccgccgaancgctttctctgtctcgctcttcctccgccccccgaccacacccccttaaagggccagcccctctacaggcccctctcccctactccgcccccgggcaggggtaggggagggtctattcggcagggggtggcctagctgtccgtactccccaaacgcaaccttccagtcccaaacccaggcgttctaagcgctcaggacgacgatttgcgctcacgccaggaccctagtcttcattggacccttcctcattctgtcctcattgaggccatctgagaataggggctatctgagaatgcaggggagtggacatcgtgtgcagacagggagtctgattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaattacaaaaaaaaaaaaaaaaaaaaaaaaaaaacaaaaaaaaaaaaacaaaagaaataaaatacaaacaaaacacagacgaagaaacgaaaagaaaaaaacaaacagcgactgacagaaaacagaacgagcgagacacgaacaacaacacaacagaaacggaccacgaagacgggcggtctgccgccgcgcagcacggatccgccctcagcggcgagggaggcgagcgggtcggcggcagcaggccatccacgcgactacggtcggcccggcgccgggcggcgcgatggcggcgggtcggctgacgagcc

SEQ ID NO: 14927 - DNA, 621 bp, Homo sapiens
catctttaaatggtctcattcattcgtgtattgtctgtctcccacttctagattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaattacaaaaaaaaaaaaaaaaaaaaaaaaaaaacaaaaaaaaaaaaacaaaagaaataaaatacaaacaaaacacagacgaagaaacgaaaagaaaaaaacaaacagcgactgacagaaaacagaacgagcgagacacgaacaacaacacaacagaaacggaccacgaagacgggcggtctgccgccgcgcagcacggatccgccctcagcggcgagggaggcgagcgggtcggcggcagcaggccatccacgcgactacggtcggcccggcgccgggcggcgcgatggcggcgggtcggctgacgagcc

SEQ ID NO: 14928 - DNA, 365 bp, Homo sapiens
gtcaccgtctgaacaaccagggagtcatgggggtggagaagcagagcccagaaagcgggctagcctgcacgcacgccaagatggagctccaggctagcccacagaacagcccagccgcagccgtcctaccagaccagcaccttgtaaccacagtctaacccagcgggcaccaggcggtgagacctcctgccgctgccagcccaggatagcccccttgcctcttgcccaaggctcaggctaccccttgaggcgtctggaggacactaggcttgacctggggagtggcatgatggggggcagggtccgaggcaacggagaaggcagaagtgacttaggtcaggcaagaaagagtatatattgggggc

SEQ ID NO: 14929 - DNA, 796 bp, Homo sapiens
cagaaagcgggctagcctgcacgcacgccaagatggagctccaggctagcccacagaacagcccagccgcagccgtcctaccagaccagcaccttgtaaccacagtctaacccagcgggcaccaggcggtgagacctcctgccgctgccagcccaggatagcccccttgcctcttgcccaaggctcaggctaccccttgaggcgtctggaggacactaggcttgacctggggagtggcatgatggggggcagggtccgaggcaacggagaaggcagaagtgacttagattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctccaaagaaaaaaagaaaaaaaaaaaaattgggggggggcgccagaagactttttaaacccatttgtttgggcgccgcggagcccagcgtgggttatgtcagacttggcagaacgcgctccaagggaaacctcttggccattgaaatgtggggttgtgttttccccaaaaaaaaccccgcggcggcaccggtggtttgaccacctcgagtggcgtctggcggcactacgggcttcaccacgggcagcgactaatatgcgccgcgcgcgtgggaaaactagtagcacaaacagacgaaagcagtacgccatggca

SEQ ID NO: 14930 - DNA, 1748 bp, Homo sapiens
aaggtagctcccttactgtgggacataaaagttgcttgttttcagctttgaccagtgatgaactgataaccctggtaggaaaatgaaacattggggctgggcttgtaatacgctttcttaaaagaatgccccattgaaattagagtggcacggtgccaccagaccaagggttctcatcccgatgccacagagggaccacaggtgttatgaagtggtttgcaaaattgaatgtatgccaaaataaaataataaaaataaaaataaaaccccacaacaaaagcagatatggtctttagtgctcattagatctcaaagggtcattactcctcaaagattaagaaactgcttctttatgaggaggttgtcagaggagctgaatagtatcaataagaggaagatgtttgagattcaaaaggaagtaatattcgactaaggcatagcttctttccatcttaaaaaaaagccacccatgaaaataaatatagtttaaatttcctatttaagatgtcttattttaaaaatgatttgcatactctgtgtgtttgagttggctatgaaggagaaatcctagcatttccactcttgtaactagggaaaagcattttgaatttttagcagtagtatattatgtgatgatgactcagctgacttcccgtttcaaatggaatgttcaaaacagattgaaacctggttgaagaattttatactttgaaccttacaagatattttctgcaaacagtgactgattggattttgtataataacaaacaagattaagccaactcagttgttttgctgttcttattagtggttttcagtcagggagcacttattgagcagtttgctgcaataatattgaatatttttagagttatgacgtctgtgttttgttgactttggtcccttctttctcccattcttttgaagtttccctaaaacatgtgtgcacagacgggagagaatggtagttaagtatgtgctgattttaaatgtccttttaaatatcatttattccttgataattgactgtataactgatgtaagagaaatatgttttatatgttattccacttgtgaatctctttgcaatgtgaggcatatagtgaaaatcttacaaagatagggtcataaaatgtgcattctctacactgctgcaggttaatcgtcctcgagccacgtttctgaggcctgtcagtcactatttcttagaaacctttgttggctccttcccagtgactctggaattaaagcccagactcttgtttttttgctcagcttatcaatttagcactgtcccttccaccttttgccctgtccctaactcttccttctctgaatgtacctttcagtttctctcaacttttaaataacagctttattcagataaaattcccatatgataaaattcacccttttaaagtccacaaagtgtatgatttaatggtttttagtatattcacagagttgtgcaatcagcaccactgtctaattctagaattttcaccccttcacccaaaaaccccataatagcagccactccccatttgtcccttccacccagcctctggcaaccactaatctactttctattataactctatggacttacctattttcgtttaagtggaatcatactatatgatacttttgtacgtgacttgtcttatttagtgtagtgttttcaaggttcgtccatcatgtcgcatatatcctttattcctttttatgggcaaataaatttcattgta

SEQ ID NO: 14931 - DNA, 242 bp, Homo sapiens
taaaaaagacacaaattagccaggcgtggtggcacacacctgtagtcccagctacctgggaggctgagacaggaggatcagctgaacccgggaggtggaggttgcagtgagccgagatcacaccactgccctctagtattgtcactgggtgacagagcgagactcagtctgaaaaaaaaaactgacttcctattttgtctaatttatagctttagtgaattaaagaaaaaagttctagcctg

SEQ ID NO: 14932 - DNA, 476 bp, Homo sapiens
ttataataatgacttacatgaacatatctttcctcttttgaatactacctgattcagagaaacttctaatattccaacgggtttttctcctcatgattatttatatcattgtgtccaaagtttcttgatcatccaccccatgagtaaaaacttttgagcatgtgcccccaaaatatatttacttgtaaattttatatgtaagttactgtcaacccatatagtatatatttttagagcttaatttctttcttattttagatacaaataaatagaaactctaatattttactcctgtgctccaggaaattatcatacagaaggaatgcttgtaccccactttggaggatattacataaaaagaaaggggatatgtacgaggttgtcatcattcctgcaatgatagaaacaacattcttctcccacctcaatgaactgttgttctgacagatatacatataaggccctctgagctaatg

SEQ ID NO: 14933 - DNA, 445 bp, Homo sapiens
tatttcattcaatttttttctgagtcttatgccattatatgaatacacctgtgatctgctcaccagcaggcccacatcacaagtgacagctccaccaatgctggattccaacatcttataatctgatgtagataaatattttaaaagactaacccactgcactctattatttttcattaagtacagcctgtcttgtcccatcagacagaggattagttcccacataacctaaaagtaggtaattctaggaaagaaatctgagacagattgctcaggaaccatgctggaaaggatcctaccaggtactcctcactgccagaacaggtgtaaacttgtagacttatccctagaagacaagatacccataaaaaaacttaaaaggtggatctgtcagcagaaactctacaagacagaagagagtggggaccaatattcaacattcttc

SEQ ID NO: 14934 - DNA, 413 bp, Homo sapiens
ccagttggtgtgatagaatgacctgcctttctactacagaagattctcatagtcaggatttttcacaacacagcaagtgccattttgacctggctccattgcttccatcatgcatttaacatatttagattgtaaagaaaaactgtaggagtccttctgtctctctcccttcctgttcttcactaaactgtattcctagctatggctacattgagtaattccatcccttttaatttgtggatggaaataagatgaaaagttcttgaaggaaacttagaattctacaaagtttgccacacactcttaggtcggactatgaggaagggaaaattgcatgcctcactttcttcagatatgtaaaataagccaccttgttttagagattttagttacacgtaggaagtctaaattaa

SEQ ID NO: 14935 - DNA, 386 bp, Homo sapiens
ccccgtttcttttcattcagtgtggagtctggagacgacgtgcagaaatggcacctcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaaggtaacttattttgtcagaatttcct

SEQ ID NO: 14936 - DNA, 4354 bp, Homo sapiens
cgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgaaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcataaaaacaaaaaaaaaaacaatcaaaacaaccgaaaagaaggggggggggcgcaaaaataaccccgggggggcccgtcgccccctttttttaaaaggggcgcccccatagaggcggacgcaaattaaaaacagagcagacgcggccggagtaaaacaacaagcgctcgcgggggaaacaaacgcacgtcggggcccatcttggagacagagcaccccacacttgttggccgtgcatacgtggggaccccacccaagagatttaagcgcccgaggaaaaaaccgcggagttttgcgaaccacagcacattccgggcgaaattgtcttctttttaaagcggcctcaaatagttcatcaaaccaccgacgcacaacatagaacaccactacaacagtctcaataac

SEQ ID NO: 14937 - DNA, 4376 bp, Homo sapiens
cgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgaaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtctctcttttttctcttccaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcataaaaacaaaaaaaaaaacaatcaaaacaaccgaaaagaaggggggggggcgcaaaaataaccccgggggggcccgtcgccccctttttttaaaaggggcgcccccatagaggcggacgcaaattaaaaacagagcagacgcggccggagtaaaacaacaagcgctcgcgggggaaacaaacgcacgtcggggcccatcttggagacagagcaccccacacttgttggccgtgcatacgtggggaccccacccaagagatttaagcgcccgaggaaaaaaccgcggagttttgcgaaccacagcacattccgggcgaaattgtcttctttttaaagcggcctcaaatagttcatcaaaccaccgacgcacaacatagaacaccactacaacagtctcaataac

SEQ ID NO: 14938 - DNA, 2374 bp, Homo sapiens
ccccgtttcttttcattcagtgtggagtctggagacgacgtgcagaaatggcacctcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcataaaaacaaaaaaaaaaacaatcaaaacaaccgaaaagaaggggggggggcgcaaaaataaccccgggggggcccgtcgccccctttttttaaaaggggcgcccccatagaggcggacgcaaattaaaaacagagcagacgcggccggagtaaaacaacaagcgctcgcgggggaaacaaacgcacgtcggggcccatcttggagacagagcaccccacacttgttggccgtgcatacgtggggaccccacccaagagatttaagcgcccgaggaaaaaaccgcggagttttgcgaaccacagcacattccgggcgaaattgtcttctttttaaagcggcctcaaatagttcatcaaaccaccgacgcacaacatagaacaccactacaacagtctcaataac

SEQ ID NO: 14939 - DNA, 3551 bp, Homo sapiens
cgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgaaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggtgagagatgtctacaacttactagaaatttacataccaaataatatgtgcttattcctgtacagtctctaaaataaattttcataggtacatagccattaacagatattagtgcacaatcttccaatttttgttaatgctttgcacttacaaccttaaaaacagatgtttgtctatattcctggcatacttgaaaattgattaatatgtctttaaatgatacattaattcttaatcaccttttcaatgctgagagttgttgcttgtcaacctgatgatatactaatgggttttgtattattcaaagtgccaggaattggggactttaccgatgtcctaccactataattgttatgtttctgtattttttcactatagaactgtttttttatgtcttactaatgtatttgtccctgcacacattaaactaccttatccttcaaaataaactcctaattatggcatta

SEQ ID NO: 14940 - DNA, 2062 bp, Homo sapiens
ggctgaagtgggaggatccaccaggaggtggaggttgcagtgagctcatatcacaccaccgcactccagcctggacgacagagtgttacaccatctcaaaacaaacaaaaaaaggcagatagagatgatgagaaaaagtccaagattgaagaagatgtgggtgggttcagatgaagaggaggacaatggtaaggataagaaaaagaaaaccaacaagatcaaggagaaatcattgattgggaagaactaaacaagatcaagaacatttggatcagaaactctgatgacattcacccaggaggagtatagagaattctacaagagcttcaccagtgactaggaagaccatttggcagtcaagcacttctctgtagaaggtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcataaaaacaaaaaaaaaaacaatcaaaacaaccgaaaagaaggggggggggcgcaaaaataaccccgggggggcccgtcgccccctttttttaaaaggggcgcccccatagaggcggacgcaaattaaaaacagagcagacgcggccggagtaaaacaacaagcgctcgcgggggaaacaaacgcacgtcggggcccatcttggagacagagcaccccacacttgttggccgtgcatacgtggggaccccacccaagagatttaagcgcccgaggaaaaaaccgcggagttttgcgaaccacagcacattccgggcgaaattgtcttctttttaaagcggcctcaaatagttcatcaaaccaccgacgcacaacatagaacaccactacaacagtctcaataac

SEQ ID NO: 14941 - DNA, 3477 bp, Homo sapiens
cgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgaaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcataaaaacaaaaaaaaaaacaatcaaaacaaccgaaaagaaggggggggggcgcaaaaataaccccgggggggcccgtcgccccctttttttaaaaggggcgcccccatagaggcggacgcaaattaaaaacagagcagacgcggccggagtaaaacaacaagcgctcgcgggggaaacaaacgcacgtcggggcccatcttggagacagagcaccccacacttgttggccgtgcatacgtggggaccccacccaagagatttaagcgcccgaggaaaaaaccgcggagttttgcgaaccacagcacattccgggcgaaattgtcttctttttaaagcggcctcaaatagttcatcaaaccaccgacgcacaacatagaacaccactacaacagtctcaataac

SEQ ID NO: 14942 - DNA, 3082 bp, Homo sapiens
cgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgaaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtaagttatttttaaaatccaccagctcggttttcttatgttgccattgtatcttttttattaaaatgtaaatacttgaagtggattcttagttttgaacagattcttctctaagaacaagcccaatttagctaagaccttttaattttttaaataatttactcaaaccattatcttctcaatttttttcccttgttgtccacacttaattatcatctgtatgtttttctctggtattgttatatatctgtaacatacaaaggttcttcaccacattgacgcagtacatatacctgaactgtgccacaaaaagttgtctacattaacagactttcatttccgtaatcgttttattcctaccacactattttttcatagactattaaaaattcatgactgtttttatttaaaag

SEQ ID NO: 14943 - DNA, 1596 bp, Homo sapiens
gataaaccccagattgagtatactttaaagagactgaaattgatatttcatatgtgtgattctaagtttttatcctatcatacttaaaattagatttaagtgattttttactgaatttttacacattttcctatacaatgaggattttaaaaaacttcgaaacaattgcattttgttttagttttataattatcttgtaaattacatcctaaagtagtgtttcttttgttgaaaaaaagttaaaattttggccatgagcttaaaattctgtaaatgtaattttcaaaaagaaattaataaaagggagccttcttttgcttttacaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcataaaaacaaaaaaaaaaacaatcaaaacaaccgaaaagaaggggggggggcgcaaaaataaccccgggggggcccgtcgccccctttttttaaaaggggcgcccccatagaggcggacgcaaattaaaaacagagcagacgcggccggagtaaaacaacaagcgctcgcgggggaaacaaacgcacgtcggggcccatcttggagacagagcaccccacacttgttggccgtgcatacgtggggaccccacccaagagatttaagcgcccgaggaaaaaaccgcggagttttgcgaaccacagcacattccgggcgaaattgtcttctttttaaagcggcctcaaatagttcatcaaaccaccgacgcacaacatagaacaccactacaacagtctcaataac

SEQ ID NO: 14944 - DNA, 2348 bp, Homo sapiens
  misc_feature (2219)..(2219): n is a, c, g, or t
  misc_feature (2226)..(2226): n is a, c, g, or t
  misc_feature (2228)..(2228): n is a, c, g, or t
cgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaacagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgaaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggagganagattcntnctttttgtcttcaattgagggattcttcctgttggccggcccatgagaaatggtcgtggattactcccttttaaacccaatggaccaccgctggtgggacctttaagtccacgggaaaaa

SEQ ID NO: 14945 - DNA, 644 bp, Homo sapiens
ctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcatatttgtctttgcatttttaatgagaaactattaataatcctgaagttcatatgctaaagttttcttattttaaagcaagtattttgagtgttacattatgcagagaagcaatgtggtttagttagcgaaagaaaaaccacttccaaaccaagtaaattttctacttatagtttactccaaggaaaaaaaattggtgtatttaataacaaaaacaaaaatcttcatattgcaaaataaacatcttctaggtagttttgatctattagtagatatctgattatgtggcctgctgaataaattctttgaatctcatttttccttatgccca

SEQ ID NO: 14946 - DNA, 329 bp, Homo sapiens
tcattcatttgatgaggtcatgttttcctggatgctgttgatgctagtagatattctttggtgtctgtgcattgaagagttgggtatttattgcagtcttaattgtctgggattatttgtagacatccttcttgagaaggttttggagatattttaaagggcttgggtgttgtgatctaaactgtgtctgcatatggggcatcctgagcctactaaccctgtggtttttgcagactcgtagagataccacctttttggtcttgggcaagatctggaagaattatctgtatttccaggcagagactcttcttctttctttaagttctccc

SEQ ID NO: 14947 - DNA, 352 bp, Homo sapiens
cctgggcatatctggagtagaaggatcactgtggggcagggcaggttctgtgttgctgtggatgacgttgactttgaccattgctcggcagagcctgctctcgctggttcagccacaggccccaccactccctattgtctcagccccgggtatgaaacatgtattcctcactggcctatcacctgaagcctttgaatttgcaacacctgccaacccctccctcaaaagagttgccctctcagatccttttgatgtaaggtttggtgttgagacttatttcactaaattctcatacataaacatcactttatgtatgaggcaaaatgaggaccagggagatgaatgacttgtc

SEQ ID NO: 14948 - DNA, 432 bp, Homo sapiens
gaggcaaagaaataatatttgcctgtttatctattggcactaagaaaagaaaccaaactcaagtatacacagaatttgaattgttccctccctgcagggtattgcaacttctctaattaaagcaatgaatgcagcgggatgcttaaagcccaagttcccctttttaagtataaggagatctgcactgctatatatagcacttcatctcaaaggtatgtcttttttaattatttactactcagaacaaatttaacattaatggtagtataagtgatgaataggattgttaaactgtgttgcctgcttggtgagagagaaagagagagtgttagtagcaaatacaatacagggcaaatattttaaataaaatgtcaaagttaaaattctattttcaaagtagggactaagtaatacagtcagctgtcaataatc

SEQ ID NO: 14949 - DNA, 1727 bp, Homo sapiens
  misc_feature (1069)..(1069): n is a, c, g, or t
accatgagcagggaaaggacttggaaaggaataattttgaggagtataaatgagtcctgaaactttgaaaactgctgcttgaggagattctacagccagaggtgccaagagatggctcttgctattatttctgcccctagagattgtcagctttcttttggagctactttggggtggggaaactcttaacaccttccagatactggatgttctgcatgaaaagtccaggattgaagcatcttggtgatgtagctcttttcttcaataagcttatggacacaagatgctcttgtagacacaagatgcttataaacacacacacttcctccgaggtgtacccacagtgccacaaggggtttcactcctagctgcactctgacctgaactgtgtctcttcttagttcatctaggttttgttgagcactggccactagttcagactctaaggcaggttctccattgcgccttcctgacatctttttctgacctgtatgatgacagtccgggcaacctaagtccatgagggatgtcctaatatcattgctccttctcagtgatctttgagctccaaattctcatttgtgacttttttttttttttttactacaacagatatctacatctggtatctataaaaatcaaaggtagtattcaagttccctccagcccctccacccctcccctacccccacaagtattcaccgttagaaacagaagtggctggaaactcacatggtgtttcttttgttcctttacagaaatgtgggcctatggagggctaaatttgctcatgtgaaacttctgctaacgttgttcataatttcttgaggctttcatgtcacactaatattttatgatttagataaaatttagtctttgttatcacagagtttaacaaccatgtagaaagaagatgagtccaaagtaatttttttgtttttgagacagggtctcgctctatggcccaggctggagcgcagcggtgtgatcatggctcgctgcagcctccagctcttgggctcaagcaatcctcccatctcagcctcctaagtagctgggactacaggtncatgccactgtgtctagctaatttttttttttggcagagacaaggttttgccatgttgccaaggctgatctcggactcctgggcttaagtgatctgtccatccctgcttccgcctctcagagtactgggattataggtgcgagccactgtgcctggtccccaaagtaatttttttattgtccggcttctcatctgtttcccagagttttcccattcactaggtcatttaattcttaaacaaatctaggtaaggtggatagtgacaaatcaactgtggtgagtacttgtatcacgacatactaagtttagtttcctgatattcaaagtagaaatattccacctacctctcaagactgctgcacgaattggttgactcagttcttaagccatggaacttgctctactgtgagagcactgtggaaagagcaactgaccctgagtagtaggattggaggagggaaggaggtcagcaacagggaactcatagtggaaagcaagacttgtaagggcagagtgagaatgtgggaggacattccaggaagaagaaactggatagtcgagagcccagagttgagacacactgggaaagtagggaattacagattccttagtcgacctccagaattagaaatcaagtctatgtaagcttacttgaaaa

SEQ ID NO: 14950 - DNA, 424 bp, Homo sapiens
gactttcattattctacttctcttccaaagcgtggctctatgttccttgctttgtgattctcccctctcagaatgaatcactctgtgcttccttggtcacacagtgtatacttcttttaagagttaattggaattttggctgggcgtggtggctcatgcctgtaatcccagcactttggaagtctgaggcaggtggatcacaaggtcaggagtttgagaccagcctgaccaacatggtgaaaccctgtctctactaaaaacacaaaaattagccaggcgtggtagcatgcacctgtaatcccagctactcaggaggctgaagcaggagaatcacttgtacctgggaggtggaggttgcagtgagccgagatcgcgccattgcactccagcctgggtgacagagtgatactctgtctcaaaaaaa

SEQ ID NO: 14951 - DNA, 383 bp, Homo sapiens
cagccctggactcctgggctcaaacgattctcccacctcagcctcccaagtagctgagactataggcgtgctccaccatgactggctaagtttttatttttgtagagatggggtctcactatgttgcccaggagtttaagaccagcctcggcaactcctgtctccaaaaagtaaaataaaaaataaatatggctttacaatgttattctttccagaatttctgataatttcaagtgagagaggtaaacatttttagttatatgatcagataccccatacgattcgcagacaatttaatctatctccagtcagatgatttaccataaagaaagccaccaaaaattgtaagcagtctggattcgtgtttattgaaaccagtaatt

SEQ ID NO: 14952 - DNA, 266 bp, Homo sapiens
cccatctcagctccgaattctggccccatctctgctctatattctgttgcagtgactcaggccaagcttcacttaatacctgcaaagaggtggagggatcagaggcagccctatcgagcttgctgatggatgcagaaggagatggcctggtgcccctattcctcagggcctgtgactgtgagccctactcactaggatgccatttggagaatagcataacattcttcatcttctgtgggtcagatgttgggttgtgtcttgggatt

SEQ ID NO: 14953 - DNA, 220 bp, Homo sapiens
aaatttctattaagatttcttcttctaaaaaaaagatatcttctttaaacaaaaccatgttatttggagataagtatacattcatgaaactatcagcacaatctatgccataaaactacctgtcactttcaaaagttttctcctgccttatttgtgtgtgtgtgtgtgtgtgtgtgtgtgtgtgtgtgtgtgtgttgagaatacttaatataagatctac

SEQ ID NO: 14954 - DNA, 335 bp, Homo sapiens
ggaggagtgagacttcagaagagaaacgcagcacatcaaatatctgctgtccatctaagatcagagccgggctgcaaggccacatggctggattggccccctctccccacttcgttctcccaggccagcctacagccgctgcacgcgttcatcttgcagcctgggccctgccagcaagactgtgcccgccaagacagcctctacacacccagaggacagtgggccccccagcatggccaaactgccaatgagacaatgttttcccttcatgaagaggtaactgggacaaggaaatcccttaaggaaagaggaaaagacctcggtgtctgccttgc

SEQ ID NO: 14955 - DNA, 421 bp, Homo sapiens
accattaggataaacaaatagagatttcagaattcttccacatgtaagtgatgccctagtactctaatttataatagagggattgttatggcttatactgaaatactagaagagagttttgcttgcaagacgtgtatacacataggctgatttcatattaagtaattctgctttattataataattcatcctgatcattgttcaataatggattcacattctaccttggttttgtgattgtgctggtgttgtagtataaattatagttattatgcacttcaaatttaaatgttattgataagtaaaattaaacactttccatatgacagcgtgggcagatatttttgtgtagtatgaaacagtgaatttcaaatagtagttaatttcttaaactaatattgagcattatatccctaaagat

SEQ ID NO: 14956 - DNA, 747 bp, Homo sapiens
cttaatacaaaggaaaaataataaagattttataagtagttaacattgattttattatctttactgttgttctcttatacttaataggaatttggcttttctggggattacctgctatagtacatatgaaacatcagtaacatccctaaggcggtttgctttgcagccgagccaaaatgctaaagtaagaagaatctttggctttaccaacatgccttggggtggagggagtgggattttttttccctttaattcagatttttctaatcttagtgatagctgatttgtgcttgctagcatataggctttgccatttcaaagaacatattttcagaacattaattcgtgtttcaatactccatttaacttctgcgccaagttccatggacacaggcagcttttggagtgttggactcatccacatccttggtgagctgactagtgaacgagtggcagtgtcttcccatagcagcgtgttcgtgtgattgggtataggtcagaaattttcagaacgttttagtgaagagtgaatggggcagcattttcaaaaagaaactttctgaggggtcactctattttcatatggttaggaaactgcttgaattggtatcggttcttgctgatttattgcctgagcatttgtgttatttctgatattacgcttcatggcaacatattttactttagaatttcccccatcatgcaggcattctagcttgagagcgtagtgttcatattcagagtgta

SEQ ID NO: 14957 - DNA, 2554 bp, Homo sapiens
tttagtattatctgtagaattttaattttattttattgtgataaatggctctttatgcaatggaaatgttgccagagtccctgttcttggacacctcttaaaccaaatgccatttaaatgaccacagactaaatacaaagtaggtaaatgcttacagggaaaggggaaagtggatcaaggtagaaaaaagacaatttgttttaaacactcttaatacaacttgttctctctccccttaaacatgtttaaaacaacgtaaagcacagatgattgtctgaaagaaaaagaaatcatttgcacagcccctgttttccagcttggtgccctttgatgggtggtgagtggtagcgatgtggcccagtgagacggcacagtcgctcttcctgcaggtcagaatcttcctaggctgttgctcttccaaggtactctgagtcctgcgatggtggcctggggttttgtttcctaagaagtagttgccattattttgattcatcctactgttctaaccaaaacaaaaaccaaaaaactccaaatggtaacagatattcatatacccggacacccaagtcagtgagtgtcacgtggcttccagatttgcatctgtgctgcagtagtctttcttcctggcaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgtcttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaact

SEQ ID NO: 14958 - DNA, 653 bp, Homo sapiens
taataaatccattccctttacaatcccgctttacttctcttctgccaatttaacatattccccatcccttcttttttctcctggatcctcgggtagccctggcctcttttcccttaccctattctctgtatatgagtattgattttcttggaaatcggtcactattattgggcaacaggcaggactctccaacccctcctccctctcattacttgctgtctgaattttgttgttctccccccctctttgcccatccgtttgtcttcttgggtgttacgggtttaggggctgcaggtgggctcccattcaccctctttttgttttaacttgaaaggatgtgtgaatgaagtccaaaggtggatcacaaggctatttcaaggccaaaatgtactgttctgagctgtgggtgtgcagaagggtctcccttaagctagtagaaatttaaaataacaaaactttattttgagtccattggtttttttttgtttgtttgtagaacttatacacaacacaaggtttcttctttgaatgcaggtgattccttcaacacccagaatgagccagaagacatgatgaagaaatccctttctatgacacacatggactgtgttgtttatttctgtttgacttttaataaggcaaaggtgtgtttg

SEQ ID NO: 14959 - DNA, 426 bp, Homo sapiens
taataaatccattccctttacaatcccgctttacttctcttctgccaatttaacatattccccatcccttcttttttctcctggatcctcgggtagccctggcctcttttcccttaccctattctctgtatatgagtattgattttcttggaaatcggtcactattattgggcaacaggcaggactctccaacccctcctccctctcattacttgctgtctgaattttgttgttctccccccctctttgcccatccgtttgtcttcttgggtgttacgggtttaggggctgcaggtgggctcccattcaccctctttttgttttaacttgaaaggatgtgtgaatgaagtccaaaggtggatcacaaggctatttcaagggctggggcctggggggggggcggttttccccccctcttttcggggt

SEQ ID NO: 14960 - DNA, 2418 bp, Homo sapiens
tcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcagaacttatacacaacacaaggtttcttctttgaatgcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgtcttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaact

SEQ ID NO: 14961 - DNA, 2536 bp, Homo sapiens
taataaatccattccctttacaatcccgctttacttctcttctgccaatttaacatattccccatcccttcttttttctcctggatcctcgggtagccctggcctcttttcccttaccctattctctgtatatgagtattgattttcttggaaatcggtcactattattgggcaacaggcaggactctccaacccctcctccctctcattacttgctgtctgaattttgttgttctccccccctctttgcccatccgtttgtcttcttgggtgttacgggtttaggggctgcaggtgggctcccattcaccctctttttgttttaacttgaaaggatgtgtgaatgaagtccaaaggtggatcacaaggctatttcaaggccaaaatgtactgttctgagctgtgggtgtgcagaagggtctcccttaagctagtagaaatttaaaataacaaaactttattttgagtccattggtttttttttgtttgtttgtagaacttatacacaacacaaggtttcttctttgaatgcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgtcttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaact

SEQ ID NO: 14962 - DNA, 793 bp, Homo sapiens
cattataatgtcatgatgacaacattttgtgagagaagtctgtataaaaagcaattgctcttttgtttccaaaacaggtattacaagtggataaataatgtgcactgctctgagcccaaaggtacgcagtgggcctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaaggtcaaaatccaaattattctcatttccttgtttcagtgagtcatagaaggaattgtctctcacacttttgatatataactcttgagggtggggtggccagaagaagcccagtgtcctaagatattgtgctgagattctttaggaataatacttaacagaggatgaagtttgttgaactgtctgtagatggaattgcaaattgaacaaaattactttatggccttatgtatttaaaaatctttggacaagagtataggccctagcaaaatggaaaatgaccatatgcaaagcatggaaaacctttgtaaaaagcactcatgtttgagatagcttactttttatgccctaataagcaaatggcaaaagtaaaaattattttagaattccccttaaattataagagggtaaaataaaatctatcattttcat

SEQ ID NO: 14963 - DNA, 2033 bp, Homo sapiens
cattataatgtcatgatgacaacattttgtgagagaagtctgtataaaaagcaattgctcttttgtttccaaaacaggtattacaagtggataaataatgtgcactgctctgagcccaaaggtacgcagtgggcctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtct

SEQ ID NO: 14964 - DNA, 2254 bp, Homo sapiens
  misc_feature (1)..(3): n is a, c, g, or t
nnnggagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggtcctctccaacatgggtgtctgggttttgactgcctaagagaaggtattacaagtggataaataatgtgcactgctctgagcccaaaggtacgcagtgggcctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttgggatttggaggccagtgactatgcttcatctatttctctgagaaagaatctactcaacaagaaaaggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtct

SEQ ID NO: 14965 - DNA, 485 bp, Homo sapiens
tttcttataaatcaaatagctttaattactatttttcattaaatttttattagttggtacaatatttgattttgaaaactgcttcatgtcaaccacataaatgaagttctgtgaaacccccaaatacacatggagaaattttagatacaggcatatagaaagcaggtccaaaacctttatcaaaacctacatgaaagtggtaagaacaagtggtaagaatacaagtcatctcccactggctgggagtcaaaaaaaaagtctagatctcaagctgacgccaagtaagaagaattgaaacagattttataggctctatgatgtgacttcccagactttctctcacaatcacatcctcttcccaacattacagtgcccgtatgtatccataacattttgggcaggagagggagtcagcagggtctttgatgatcatgcaacattacctcttaatattaaattttctgatatttgcaagaagccgatga

SEQ ID NO: 14966 - DNA, 1360 bp, Homo sapiens
atttgccttcagatgtctttggggcctgaactttacatggtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtct

SEQ ID NO: 14967 - DNA, 1526 bp, Homo sapiens
tttcttataaatcaaatagctttaattactatttttcattaaatttttattagttggtacaatatttgattttgaaaactgcttcatgtcaaccacataaatgaagttctgtgaaacccccaaatacacatggagaaaaaaaaacaggacttctttcatagactatatgctaactcagacattttgcaccaagtagaaaaacaatgggtcatgaaatacaaaccaaaacactaatttcactagaaccaggggttgattcaaggtactgtaagaattctcggaatttaacacttttgatattttttcatttcagatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgcttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtct

SEQ ID NO: 14968 - DNA, 1204 bp, Homo sapiens
  misc_feature (1)..(3): n is a, c, g, or t
nnnggagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggtcctctccaacatgggtgtctgggttttgactgcctaagagaaggtattacaagtggataaataatgtgcactgctctgagcccaaaggtacgcagtgggcctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttgggatttggaggccagtgactatgcttcatctatttctctgagaaagaatctactcaacaagaaaaggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtaagtaaaatcagtcagacttcttaccaacggttagtctttcttgcactacaaaacatattctgtgcaatctcgtatcagtctaatctttacctatatcaattttcttgaaatttattttaagcccatatgaaaaactttgtagtcctacaattcattttgagattcaaaactgaactagttgttcaaaataaagtgtcatttaatgctgcagaccaatatctaaaactttagaataataagtcaactccctgaaaattgtatttgaaaa

SEQ ID NO: 14969 - DNA, 530 bp, Homo sapiens
gcacaaatgttttaagagttgaggaattttcaactctttctgaaagaataggaagatataaaggcttctcagagacggtattatttaagctgattttgtttttgtttttgagatgaagtcttgctctctcgcccaagatggagtgcaatggcgtgatctcagctcactgcaacctctgcttaccaggttcaagtgattcttctgcctcagtctcctgagtagctgggattacaggcatccaccaccacacccagctattttttgtatttttagtaaagacgaggtttcaccatgttggccaggctagtctcaaactactgatctgaggtgatccgcccaccttggcctcccagagtgctgggattataggcatgagccaccatgcccggcttatttaagctgattctttaagggtaagtagaaattttttccaggtgaataaaaccttgagctattattccaagcagagaccagtaggtgcaaagacacagggatatagagatgttgaagtttaccaaacactgctagat

SEQ ID NO: 14970 - DNA, 431 bp, Homo sapiens
aggaactcagaacatgcaggcaggtgctggaggtagggcaggtgtgctggtaagatggatgacctcagttccactggcaaaactgtgccacaggagaaacctgagcgtgtggtaaaaaccaccccagcagcaatcagtaaatgcaggaacagtgacctcaggaagacatgaggctcctaccagtgcctgtgatgaggccagcccagccctgtgtgtggttagggcacacctgaccaccccgacaaccagggaaggacggtgttggagctctgagttcttggcatgaggacatgatcttggctgattgttttccttcagaccttctgcagaattgaatgcacatcaaagaaacaagcagaagaaaccatgccagctacttgtattgaataaaagtattttacttacaaacttggattatcaaacttatgagg

SEQ ID NO: 14971 - DNA, 454 bp, Homo sapiens
tctggtttcagattgtcctgtattcccttcctggctctggtcccactggcctcttttcggtgacattctcccccaggaaccatccctggcccttccctcccccagccctagccagttctcccagacacactggaagagaacactgaccttacccaactatctgctgggatcccacccaaatttatagcccattcctccctcattcattcattcagcaagtatgtactgaacaccaactgtgtggcatacactggcttgggagtgttgctgatcctcaaaggcctctgtaggatggagggaggggaccttactcccttccccaccccagatgcaggagtcacccagcttccttctctgcgctgtttccttcacaaattagacattggtttgggaaacaatgtagcctcgttaaacatttaatgaaataaacaaataatcacactgtgaaggctgc

SEQ ID NO: 14972 - DNA, 1857 bp, Homo sapiens
tctggtttcagattgtcctgtattcccttcctggctctggtcccactggcctcttttcggtgacattctcccccaggaaccatccctggcccttccctcccccagccctagccagttctcccagacacactggaagagaacactgaccttacccaactatctgctgggatcccacccaaatttatagcccattcctccctcattcattcattcagcaagtatgtactgaacaccaactgtgtggcatacactggcttgggagattgcaaggaccagtctctaagcttttggaggccagcccagtgtggaagagaggtacctcaggtgtgagggtgccatggctgagggatatttgtacatgtatgggatgctatgggagctccttgcagcctgagaagccagtcctgtgagccaggtcctgagggttgaagaggagttttccgggcagggaaggggtaggaaaggcactctgggcagagggtacagcatgtgtaaacacgtggagatgagaatgagcatagcactgttggggctcccatggcagggagaatagaagacaaggctaggaaggtacactgaggctactgcagggtccacagaggaatcagaatttcattctgaggatgaatgaaatcatcctcagaggatgaagccaccaggaatttcaggcagagagtgaagtgatcagagttgttttttggatagatggttatctggatgtggtgttggagctgggagatttggctctgaggtgtgtcatttaaaataatagcttctcggcagtggctcacacctataatcccagccaagattcctcctttgggaggccaagctgggaggatcgcttgaggccaggagttagagactgcagtgagctatgatcatgccattgtcttccagcctgagtgtcagagtgagaccctgtctctaaaaaaaattaaaaaataaaaaataaaaaatagcttctcctttcccttatgccaggttccagtcttgagaggaaaggaatccctacccaccactccctggatcatcagatatccctatcccaacctctcctatgggactagttcatctcagccagtctcaaagattctaggataacttcaatggcatttgaaattatctaagtgtgcttggataaccaccccctcaaactgagacctggttagggactgactcaaagaccctgagtcctcggctaagggtacaggagagggcaggggctccaggcccagcttaggtggatctccatctgtctctgaggactgaccctttccccacaaggacctgccataaaaatcgacttgcgatttttagctgagtggcttctcttttccactttggacttctcagtgtatagcaggttcaagcctgcaaccaccaaagtgcagagtgtggagtgtttgtgccccctctttcctccaacctccatatcctgccatgtgagctcagggaatgcaaatgcatttaaatatccatctaaagcaaacataattagaaaaatcaatcagctggaggaccccccaaagtttaatacattttcaataccaccaggaatggatttttggtccctttctgcaggtctgggttgccagacgttttatttctggggaggagggctctgggctgaggagctcagtgggtgggaggagggaatgggactgttgctgatcctcaaaggcctctgtaggatggagggaggggaccttactcccttccccaccccagatgcaggagtcacccagcttccttctctgcgctgtttccttcacaaattagacattggtttgggaaacaatgtagcctcgttaaacatttaatgaaataaacaaataatcacactgtgaaggctgc

SEQ ID NO: 14973 - DNA, 576 bp, Homo sapiens
catgcttcctcttaggactttaggtctgcctacatgttgaagaagtttgagttttaggctttgggagcatttccttaaaaaccattgtcatgggggaggaaaaaaaaagggtagtgttaattctgtcttcacacactcagagatcatttggttgggctacattttatgagctatattccataaagatgctgcaaagttcaggtatctggtttaggaaagaaaaaaaaatcccttctttaacccaagaaatgtaatgcaaacaacttgggcctgtgtcacttagtcttctaagaagacttcaaggctgttataaagacccagtggtgggagaaacctgatccggtatagcggggccagaagaagctgcgggaccatgccgcggggacaaggcaaggagtttcgccaggatgttgatctcctggttatctacacttccgcctcagtatgatctgaattattaatgagaaagattaagatacagattccttccttcaagtgccttagtagtcacagacaggaggttaattataagactaaaagcaatcttgggttgttagaagaacttaaaggaaaaca

SEQ ID NO: 14974 - DNA, 312 bp, Homo sapiens
cccaaacttcttgccaatcgtagctaaaactgtacattacccctaaactttcccttattcagatctctaaaatgcctggtgccactccattagcacctgacataatggaaagtgtgaagaaggggaagttggagagaaaagagacagcaatctcaaccaattgctattaaaatatcttacttttgcaagtcttacaaaagcatgtgtccttgtgaacacaatgctagaatctctcccagggtattagaagggttgcctgcacttgagaggtcctgaaatttaatctctgttagcttcacagtaaacctgctg

SEQ ID NO: 14975 - DNA, 463 bp, Homo sapiens
ggccttttagcttttcagagaacttccacatgcattgatttttttttcctccttactacatttctgtgaggtgggttgaagttattattatcccttttcaccaatgaagataggctaaaacagcgaaatcaaagggcaaattagtggtggtgctaacactggaatccaaggcttataactccaaatctagttaaaaacagtggtttggcatctcactcccttattgatttgagctggacaggccaaagggatcgctgtggcgggagtcacctgatttcccttagacaactcctgatgcatcatgaggccaattctaaggaaaatagctgggagttaacctggactgtattctggaccacaaatacaagattcttctgaggaaataaaacttttatttctgccattttgtggccacttttgtaaaccattaataatggtctagatgaggccagctatttttgta

SEQ ID NO: 14976 - DNA, 344 bp, Homo sapiens
gtagaaaagtaatcttgtcttacccaaaatccttcccatcatcattttctctttctcttaaaaagacatgcgaaggaaaatgttcacacttactgaaaagcacagtgcaacgactgtggcacttacgcagtacccactcgcacatttttctctttaaataattcattcacacctgtatgcaaataaaggcatagtattttgtcatacagagtagcatgggctctttctccactgaatggctgacatagagctacctcatttttaggatctaccagacctcccatctgaaactaacattgcctaaatctctgaaagaaggaactcaaatcagccaagaaagacct

SEQ ID NO: 14977 - DNA, 416 bp, Homo sapiens
tcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtcccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgc

SEQ ID NO: 14978 - DNA, 725 bp, Homo sapiens
tccccataaaagacaagattgttgaacacctgcaagtgaataaagataaactgatctcagaggggaaaaagacgcagggttaggaaacagcaccctgctcgaggacgttctttccaaacagcctgctcatcacccgtgtaaactggcaaaggggtggctgggccaaaagacagaggaattaagtaagaagtccaggaaaaatgaacttcacatcaaattttagagcacggtagccatgaatcttgtgaatagctcccaaaaatgtcctgtggaagacaactagaaagcattctacaatcaggcacccacctccacctgcagcctcctgtgttgttctcatggggcacctctgggctccagctcctccaaggcacctccacactctctcaagtacactctttcactctttccccaaacatgattcccctactgctttgcctaactcccacttctctttcaagtagcagcttaaacgtcacctcatatttggctggaaaatagaatatagacagaggggtaagttaaggctagaaaggcaggctgggtcaacagaatggcaagctaaaacatgggattttctaaaacagcctaagagggtgacagataaaagtgtgcaaggagtggcacaactccagtttcatctttagctatagcaattaacaccataaggagtctggattcaattttgccatttactagctagctaccaacttctgtgtcgcttt

SEQ ID NO: 14979 - DNA, 519 bp, Homo sapiens
ccttggtttataatacctgagtctgaaaagagacatgaagtaacttagatcttagcaaagtttcctcacttttgatgggcttgccgccttggcttactggtcaccgccttcatctacagcaggggtccccaatccccgggctatggtccagcaacagtccatggcctgttaggaaccgggccacatagcaggagataagcggtggttacagctgctccccatcactcacagtactgcctgagctctgccttctgtcacggtggcatgagattctcacaggagtatgaacccctattgtaaactgtgcatgcaaggcatctaggttgtatgctccttatgagaatctaatgcctgacaatctgtcactctctcccatcacccccagatgggaccatctagttgcaggaaaataagctcaggcctccactgattctatattattgtgagttgtataattatttcattatatattacaatgtaataataatagaaataaagtgtacaataaatgtaatgtgc

SEQ ID NO: 14980 - DNA, 391 bp, Homo sapiens
ctacaatacttatttatcagtgtggtttgatgattacaaataatatgtaagatatttagtaaatatggtgcttaatacagttcttgagagttattactgatattcattcattcaacaagcacgcactatactggtttcagtgtaattgcgaagatcctactatataactccttatttccccttattttcaatgcagaaatgaataaccccatgtcatcctacatttctttatttctttgatacaacacccaataataacctacacctgctttgtcttgaaataatgcagtcatcccctaattaaaatgaagtatctgtcataaaggaggtactacccatggtgcccagatgttatgtcaagagtatatgccagaggccctctcggaaaaaa

SEQ ID NO: 14981 - DNA, 281 bp, Homo sapiens
agagcccactggtgaggtcctgaatcacacgtgaatgccgttcacagttggaattttcactgtcataagtgaacatctggccacagttgggatggtgactcatttctaaacccagcttgtaggaaggtgaggactctcctatctggactcaaccaattggagagatgttgactgtcatatctggacgtagaaccacagggaagactctggatctccttcctgtatgaaggtcacagaggatcaccattcttgcatattgtataaagccttcaggtgacaca

SEQ ID NO: 14982 - DNA, 428 bp, Homo sapiens
gtacaaaaatacagttagattaggtgaatgagttgtagcatttgataatacagtagggaaattatagttattactttattgtatatttcagaatagctagaagagaagagttgcagtgtttccaacacaaatgataaatgtttgacatgatagaaataccagttaccctaattgattattacacattgtatacgtctatcaaaatattacatgtaccccccacagatatgcacaaccatgatatagcaacttttctaaaaagaaattgaatgggtgcagcacaccaacatggcacatgtatatatacgtaacaaacctgcacgttgtgcacatgtaccctaaaacttaaagtataataataataaaatttaaaaaaaatgtagatccttgaatcaagatttaaaaaaaaaacttgaatctggaggaaa

SEQ ID NO: 14983 - DNA, 445 bp, Homo sapiens
tgccagtgcataaggcagataattgaaagttcgttcatgaatgtatctgaatctaaaattctagacccaatcctgaaataaaattaatgaaatatctggtcctatcttgatttactaccctaataaacaccaattaacgaatgaataaattaattcattaatctgaggttaatttagatctatttcagcacctggtttcttcaatatttgtatatagtctcctttcatgataaatacagtcttttttcatggtaaacgtatgtttgtatgaagaacaacaaagtaaaactgagataaagagaaagcatctactttcatataaagccacccattacgaagtcacagcattgctcttttgaaatttcagttgtattgctacagatacttcacaaccaatgattgactacttctgtcttcttcaggagctttaaaactcaaaactcaa

SEQ ID NO: 14984 - DNA, 203 bp, Homo sapiens
tcccaatctgttcagaacttcccctctgtagccagtgcccggctctccttcctactttgtcacatttatccacacggcacccttcaggctaagtgagtatatcctggggtctaagggtaggcccactgagatccagggaaaacacacaaatgggccaagaatctagctccacctggcatctgtgatacgaaggcccaggagca

SEQ ID NO: 14985 - DNA, 461 bp, Homo sapiens
ctatcagtctaagtattatgtaatgctaagatgtcatttgattgaaagacacatctctaattctgagatttgtaatgtgaaaaaagttgtcctcttagagaatttatgaaataggatgtctcttctgctatttagccatgctgaccttataccagtgttgttatctacttgcacaagagggggaaaatagggatatatgtatccctacacatacatacatacacaacataacgtgcattcttaaaaaactttgtggtcttcagaattatatactaaaattaacaacttatgggaaaaaataagatcaggacaaaccactccacctatagagtggaaacagaaataattatcttaataaaaatgcttgcacatttgaaaagatacattaatttcctaataagtactccagtaaatataggattttacacttttaaaaaaggtgaaagcttgataggagatgt

SEQ ID NO: 14986 - DNA, 198 bp, Homo sapiens
tctcctttttgcttcatttcctcattttggagatttgagtacctaacacttaggactgttgcaagaattcaaggagataagttatataaaaggatagagttcaagttgggcatggtggcacacccctataatcccggatattcaggagaccaaggtgggaggactgcttgagatcaggaattcaagaccagcctgggc

SEQ ID NO: 14987 - DNA, 458 bp, Homo sapiens
aggccctggcaaagatttcatgatgaagacaccaaaagcaattgcaagaaaaacagaaaagacaagtgggacctaataaactaaacagcttctacacagcaaaagacactagcaacagaataaacagacaacctaaagaatggaagaaaatgcccacacactatgcatctgatgaatgtccaatatccagaatctacaagaaacttaaacaaaataacaagcaaaaagaacaacaactccattaaaaagtggggaaaatacgtgaagagatgctttttaaaagaagacatacttgtggcaaacatatgaaaaatgctcaacatcactgatcattagaggaatgtaaatcaaaaccacaatgagataccatctcataccagtcagaatgcctattattatactatgcatctgatgagttccaatatccagaatctacaagaaacctaaacaaaataagc

SEQ ID NO: 14988 - DNA, 517 bp, Homo sapiens
gttttttttttacagtggctgtacctttttatattacaaccagtaatgcacaagggttccagtttcttcacaacctcgccatccatcatttgttataatcatgtgccacataatgatgttttggtcaatgagggaccacatatacagtagtggtcccataagattatagcagagctgaaaattttctttttataaaattgtatttattattattattttttttccaacttttatggagctgaaaagtttatactgcctaatgacattttgatgatcctggcactgtgtgtacctaggctaatgtgtttgtgtcttagtttttaacaaaaaagtctggaggctgaggcaagagaattgcttgatctgccctattaattgcaattttcacagttaactagtactatttttatttaaataatattacctgggaagcggaggttgcagtgagttaagatcacgccactgcactccagcctgggcgagagagtgagactctgtctcaaaataaaataaaatt

SEQ ID NO: 14989 - DNA, 898 bp, Homo sapiens
tggttttctgaagagtgaagcaggctgtgttcgtttgctagggctgctgtaacaaaataccactagctgggtggcttcacagaaattgatggtctcatggtgctgggggctggaagtgtgaattcatggtatcagcagcgctggttccttctgggatctgtgagggagaatttgttccacgcttgtctccgtgtatattggtccgttttcacactgctgtaaagaactacctgagactgggtaattgatgaagaaaagaggtttaattgactcacagttccgaaggcttaacaggaagcatgggtgggaggcctcaggaaacttacaatcatggtggaaggtgaagggggagcaagcacatctttaccatggcagagaaggagagagagagagcaaagcgggaagtgctacacactttcaaacaaccggatttcatgagaactccgtcactatcacaagaacagcaagggggaagtacgctcccatcaatcacctctcaccaggcccctaccccaacacatgggaattacaatttgagatgagatttgggtggggacacagagccaaaccatatctctgtgaaaggaaaatgaaatctcaggaccccaattcactatgccaaaaggaaaaacttaagctgtggctgggcactgtggctcatgtctgtaatcccagcactttgggaagccaagacaggaggatcgcttgagcccaggagttcaagatctgcctgggcaacatagtgagaccaagtctctacaaataattttaaaaattagctgggtgtggtagcacaagcctatagtctcagctactcaggaggctgaggtgggaggattgccggagcccaggagtttgaggctgcagtgagctatgatggtaccaccccactccaggc

SEQ ID NO: 14990 - DNA, 419 bp, Homo sapiens
cctccctcctcgtactaacttctagagtcttctggcgcagtctcctcttatcgtcaacaacaagaaataataatagtgatgatgatcatagccactaacattgagcacttgtgtaccaggtactgggctaagctctcttccatgctgaaagcaaccccttgagactggtattattaacttccttttatagataagggaacagagagattaagcaacttgccaagggcacctaggtagatctgggatttgttttgatctatagagtatatttgggcccagctggttctgcttccgactgtagaaatgtgtccccagcttccttctgaataacacttttagtgtatgggcatcagacttatcggtgtgacctcatcagcaccactaatagttattaaacacccaccctgaatcaacaactc

SEQ ID NO: 14991 - DNA, 934 bp, Homo sapiens
agcgggtgtagcccctgcgtaggaatgtggctaacggccagatgtctgacagttctccgacttctgggcattccacgtaggacgctttctcatgagtgtctgaaaccgtcagttcactgccagaaatggatgatacatgtttcctgataaactggcacttgccttttcaaagccaccatttcctctatcctctgggctgtcacaaatcctcctctgcacctcaggagtgccccttggagccacgttcaccacttctctgcccctgacccaggctggttcccaggccttggggtcctagcgtggacctcctggaagtaattaatgcagttttccagattaactcgaagtaccccacgactaaacgctaatgaaactagaggaggcacagcttcagctccgtgcaggatggatgcacaagagcagaatctccacgggacgcctttctggagcatcagtattactgcaggatttggaagaaacaaattcaaataatttccaaagtaagacactggaaatttaagaggaagctggaaactcatctgcctttaatacttttttttctccaagaaaaaaaaagaaactctaaggagaacctatttttcactcttctaagtagttaaaattagaaatcacagcaagtcaatagaaagctctgccttgccagtctcctaaatcacaatatggccttggtcaaagcaacctatatgtcatcatacaaactacaggctacgatgagcacctcattttctttctggaaggctgaccttaaatgtcctgcacattcctatagtgcatatttacccttttcctatactaagtaagccctaaatcttggcagtaacagcctggggaactacctgtcttgctaccactcaagaccatgcttctgtccacaaattccccccaataaattaccctttactgacaaactgga

SEQ ID NO: 14992 - DNA, 745 bp, Homo sapiens
agcgggtgtagcccctgcgtaggaatgtggctaacggccagatgtctgacagttctccgacttctgggcattccacgtaggacgctttctcatgagtgtctgaaaccgtcagttcactgccagaaatggatgatacatgtttcctgataaactggcacttgccttttcaaagccaccatttcctctatcctctgggctgtcacaaatcctcctctgcacctcaggagtgccccttggagccacgttcaccacttctctgcccctgacccaggctggttcccaggccttggggtcctagcgtggacctcctggaagtaattaatgcagttttccagattaactcgaagtaccccacgactaaacgctaatgaaactagaggaggcacagcttcagctccgtgcaggatggatgcacaagagcagaatctccacgggacgcctttctggagcatcagtattactgcaggatttggaagaaacaaattcaaataatttccaaagtcaaagcaacctatatgtcatcatacaaactacaggctacgatgagcacctcattttctttctggaaggctgaccttaaatgtcctgcacattcctatagtgcatatttacccttttcctatactaagtaagccctaaatcttggcagtaacagcctggggaactacctgtcttgctaccactcaagaccatgcttctgtccacaaattccccccaataaattaccctttactgacaaactgga

SEQ ID NO: 14993 - DNA, 220 bp, Homo sapiens
tcttccctgtgttttaccttgctcctctgccaggctgtttaagaatctacatgatttccatatggtctattggattaagagaaaaaaattttaaataagatctagtaattagtcccatttgctaaacagttttctcgttcacttttctccaaactgcattctctgtccatgttatatttgacatgctttgtgacattgccaggattccttccatttctca

SEQ ID NO: 14994 - DNA, 299 bp, Homo sapiens
taagtttgtgaggctttttttttttttctggtagatttctgtttccttgatcagtggtttttcagaattttttaaagcttgtgaaatacttatttgtaaatagcatcttatgaggaaccttgatatgtgacaaaacagatgctttgatttgagagcagaagacctgcagcccctgactgctcacctttccagggacccctgaacattggcctagagggtagtgtacagtcacttcttcagtgataacttactgagtgtgattcaacaaaactgctttggtttatgggtgaaacataatt

SEQ ID NO: 14995 - DNA, 783 bp, Homo sapiens
agtgagccagatgggaccatctccaaaccatcctgtcagtctggggtgctgtgcaggggtccgaggatctgccacccccatcctgttatctgttcccatttgcctgacccacgtcctcccccagtccaatcttccccagcgaaaccagaactgtcagcttcccgacaaccatttatcagacacgaggaaataacagcttttaaccacgcttgaagactgtgatcagattccgaaccatttccagaagtgtcccttggggcccagggggagacgtggtttccatgataacaaactctttgctgtctcccgtctccagcctctgggaagagaagcagatcttacctccctacggtgctagaggaaatttaactacaaaagctggcagagatgacatatgcagaaacaacagcatcaccttgatggggacctgtaatcaaatgtgctgtccatgacggcagctataatggagagtcttgcggcacccttccctccagacacgtcttctgggtttgcctgggccgacgtccaaaatggagagatgggggagctatgactggaagaaagactcaagttctttcccgacaggattgtagcctctccttcacatgatcttggggcttaagtactttcctgagaattattaaaaaactaagtagacaaaggagaaaacagaaaatgaaactaggaaaggctggggaggtagggaagaggcttccttcatttaaaaaagataacacatgcaaattacttagaggctctgatatcaagaaagcactccatatt

SEQ ID NO: 14996 - DNA, 712 bp, Homo sapiens
gccttagtaccacaccatctttaaagtctagagtgtagtccccttttccttcaaaactttccaacaaatctagcgctgtactgaactcagaacattgttctctttgagaatgtgaagattttatatagccaaagaattttcatgtataagagctagctaaatatagtatatcctgctctttcgaagaagatacaaaactgttgcctgtactaatgggtatagtagagcagttgaagaactaacacatacatggacttttcggtctgaatttgtgttggcatccatggtacttactgttcagtaggatgttattgcaaggagcagagtgccctctgctggagtaatcgcaattattcttgcagcagattaatttgacttgggtcatgaattcaacaaccagttacttgcctttcatcatacaatttcttcggtagttgagaatttggtctacatttatcaaatgaggaaagagtgtcacaaactctaaaaagctgaaggagaccccacagatcttctcactgtcagcagcccttacttctgcaaaatgttgaaggataatgttgctctgtttgcaaagaagatgcctctggctagaatgtttgtgcagttataagcaagggactgcttgtttttgtaagttatctcaactttattcttgtgaaattgcaaaggaagatcaataaaaagacttcatatgaatgtaaaaaaaaaa

SEQ ID NO: 14997 - DNA, 2256 bp, Homo sapiens
  misc_feature (1620)..(1620): n is a, c, g, or t
  misc_feature (1920)..(1920): n is a, c, g, or t
gctgtagtgaaaactcacgaacttgggaggaaagaatgagaaatgcaagactttatgtggccttcttgaaaaagaatctttgggggcctgtgatcatccggtctctacttggtgaattatgaccacctccaacagccagcattttactccaagtcagcatccacctgccaccccaatgctatggggaagaaaaggagcatttgcattcactcaaaataatttagggtcacctttaggaactgctacctcctatgtggctagtccctttggaagagctgagccctgactatgaatacagcttttgaacattgacttaatctctagggttagatatcccctgcagtgtcaactctggtcatctacacagggagaggtagagtctggagaaggcagaaaattaaaagcggcaaaggtacctacccatttttgacatcacatggaatgatcagaatcgtggaggcaaagctctgtccaaaaatgttcattttgttttgttttgttttgttttcttgtttttaacatttccttcatcctggtgaaatatcctggaaattcatagatctgggtttggtgatttcaaaactcaccatgcccagtggccatttcagttactgccgtgacatccctgaggctaccatactctcaaaaccaaatcaatgccagtgatctaacaggattctttcttatttatgagttttgtttagatggatatttttgcagagcataaaaaattaaatgacatttagttatccattgaatgtatcaccctgacttaaaaaaaaatccttaaatcaaaacttttcaaaaaatctgggctatggagtcactccctctgtggagcgagagcccagtcttttctggtactaaggccacagaggcaatttccagtagcatttttatatcttctctaagtttcttttccttttctgtctgtatctgtttttctctgactgcctatatcttactttgtatacccatacataaattattttcccatcttctctcttcccctttttttctgatttgttttctctcttgcaagaaactctgaaataaccttcagaacacaaaaaactggaggttctatacctacagagtcattatcattattgtgattaccattgttactgttgttggtgtttttcctctttttattgtgtagcaatatccatattcacttctgatgaggcaaacctgtttactataaaccaatgtcctccctaaaggagtcagtttcattttcacttctcacatcaccagttgtatcgcaacccatcttacaaccattgccatgttttcaggcttccttgccataaatgttttctgggcaaataatggcaaagcaacaattccagaatgctgtctagatctgctttctcccaccctcagcatttgaccctcctcattcgcctgagcccccagggttaggatttcttggaaaaacttgtatactgtacctgatggaatgcccattcttcctaactacttagcacaagtgcttgctcatcgtaagtgatctgagggccactaattcctgaagactgacaaagagacacgaagagactaccctcttaagatggggatgcatggttcttcatgcagtgctcttggccaccgagntccttcatccatgccattgcatggatgaatacgtttgatgttggcagttaaaatgggatgggagtgtcaccctgcaggaagtaagaaaagaggatggcaggatctctgatcagggagctggtcaaagcagggctggaaagcttctgtgcttaacaaaatgtgcatgctgtccccaagtaaatgctcatccctaggtttagagctgacctgggttttggggagtttgtatttttaaggaattaaatactcatgagttaaaatactcatgattgcaaagaaggtctggattgcctgaaaaanaaattaattctaagaagctaatatgagtttctcatcatcccttagctcttccttttccctccttttgtcctcactcaaccccagaccctgtgtaataggaacattaatttttaaagacccacagatcaatagccacactcttccactctacaccttttattgacaccaagttatcatcccagaactaatgaagcaagtccagatgctagacgtggccccttaatattgagcaatttgattgcaatctgcttgtttttgtaagttatctcaactttattcttgtgaaattgcaaaggaagatcaataaaaagacttcatatgaatgtaaaaaaaaaa

SEQ ID NO: 14998 - DNA, 449 bp, Homo sapiens
tactactactaaattcgcggccgcgtcgacctgttcagtaggatgttattgcaaggagcagagtgccctctgctggagtaatcgcaattattcttgcagcagattaatttgacttgggtcatgaattcaacaaccagttacttgcctttcatcatacaatttcttcggtagttgagaatttggtctacatttatcaaatgaggaaagagtgtcacaaactctaaaaagctgaaggagaccccacagatcttctcactgtcagcagcccttacttctgcaaaatgttgaaggataatgttgctctgtttgcaaagaagatgcctctggctagaatgtttgtgcagttataagcaagggactgcttgtttttgtaagttatctcaactttattcttgtgaaattgcaaaggaagatcaataaaaagacttcatatgaatgtaaaaaaaaaa

SEQ ID NO: 14999 - DNA, 1093 bp, Homo sapiens
ccactgcactccagcctgggtgacagagcgagaccctgtctcaaaaaaaaaatactgaagaattcaaggttaaactagatccctgcaaggccatcacctccattccaagttgttactttatttggtgtttttagcattgtaatagagtaagtaaatatttggtctttgtcccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcagcccacttgccaaccttggggttgcagggccagagattgaactctataaaaactcctaatttgatgtgcttctggattggtgaacaactcgacatactgggtgggtagcatgcccagagacttgatggaaactctgcagcccctccccaccttgccgtatgcatctcttccatgtggttcctcagttgtatcctttatttaaaaaaaaaaaaaacaaaacaaaaaacaaacaaaaaacagtaatagtaaaaagctttcttgggttctgtgagtcattccatcaaattatcagacctgaggaggcagtagtgggaaccctgaaatttgtagtcaagtgggatagaagtgtgcaggtagcctgggaccagggaattgcaactggcttctgaagtaaggacagtcttctccaaagctaacttcagatagtgtcagaataggattgagttgttgtacacccagttggtgtcctaagaaagggtaccccacatttggtgttagaagtaacgtcagaaagcatcacacaattgtatgtattcttttctctggggtcagatcacaagctctttgaaggtaagactatcctgtcctctgcagtacctatcatagtgatatgtgcatggtaggtgctaagagcagtaaattttgctcctgtgaaagtggttcctgtattttaagattatgccgttggatacaggtattctgtcaagcagtagaagtagagtt

SEQ ID NO: 15000 - DNA, 1182 bp, Homo sapiens
gatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctcttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcgggaattgcctgtaaattattatagacaatagattgcatgtcatactccatttggttcaacacaacaacctatgtgttatcattacagctttggctgctgttaaagaatccagctctctattttgataaagataatcttaaagctgaggcaatgctccctcctctatctctctctgtgtaatttaccatagaattaggatgattagattgaaacacatgttgtatgttttaaaaactacattgcttcattactttcattttccgacaacatcaaactaacaagaggcagtgttaaatattttaaatggtgctatagccaatgtatttgaatgcttgcactgctggttgtgtatcatcaatatgaactttttatccaatgactcaactctaattacatctaagttagacttgctcacgttcagtttgtacagttgtgtgttgacttactatgttttgaaagtggtgacttctaccgaatgagtggaagttcccattgtcaaaaaaaataaagacctgcttgcagtattcatgttgacaacagagtaaaagagaatactgtaaagaattactgcaaatatttcctgtttatgttatttgccgttgtttgaagatattataaagggttaattgtatatttatatcatgtgctttatcgttttcccctcatgtatccaagtaatttttatttacatacaactaaataaatgttgtcctctttgaagacggtca

SEQ ID NO: 15001 - DNA, 247 bp, Homo sapiens
atcttcatcacatttattttcaggctttaaagacctttccccttgctataaaggttcatgttatgtaccactggtggaccacataagagtatctatttatacaatgactttatttccctttaggaatcaaattgtaatcaaagaataaatttatttctatattcaacaaaattcaggataactgctgatatgttacatgcaggcagtttctgcatcgtaagctaaatacaattaaacagttggcaca

SEQ ID NO: 15002 - DNA, 398 bp, Homo sapiens
ggactgggaaaaaagcacaatatatttagttttcttggcacataaagtgtgaggtaggtaggggtggtcaagaaatgagactggagaagtggaggaaggtgaggccatggggtccctgggtgtcatgctgcggagctggctctcatgctgtcagcagtgggaaggaattgggatgtgtatgcctcatgcaaagtgagagagtcagacttacattttctatttgctcactcttacatttctgtgaaggatagtcctacaggcaacagacttcagtcacagaggaggccagagtggctagaagtaattgaagcttcaatttattgaatgttcactatgtcaggtactgtttgaagcatttcacatgctatttaatcctagattttctctgttttatagat

SEQ ID NO: 15003 - DNA, 170 bp, Homo sapiens
tttttcataataccctttaatataaactggtagaatgtgaagagtagtttggtaaagacgtcaaatgaatgcaaaccaagtgcgtaggcctagcttggtcacttgctctggtttgattcagggatctgttttagaataccaagaatgactgatctgtatatccttcaggc

SEQ ID NO: 15004 - DNA, 329 bp, Homo sapiens
atgagctggatcaggaaaaaaaatagggcaaaacaagcagaaatgatctttagataagaacagtattacataaaacagcacccataatatgttaaagccactctgcagtacaaatcacttttccacaaagaattaaaagaagaagaacaaatacaaaaatcaattaaggtccagggaagggctccattccttctcgaggggctgcttcttatccaaacactggctgattcatgcaggtactgccaggctgcctcagagagggtattttttatttctgcttgactttgtccatagagtgattttcccattttagtttgcaaggaaaggtt

SEQ ID NO: 15005 - DNA, 327 bp, Homo sapiens
tgtaaaaatctacaaggagctatgacgccaaaggaatccaacacaaaaggtaaattcctgagcgaggcccggcccccacgggcttctggactcggacgtgtttgttctgccagaaggatcccgccttgactgctgctgccacttggaacctggccgttaccctcaaaggctgcaactggaccctcgcggggcggggggactggcaactatacgtgacatggttttatctgtgacctaaattaaaacacattgtgattgcagcccctgccaatcaggaatgcgaccagcccaggggattcaattaaaatgctaaattaattcaattga

SEQ ID NO: 15006 - DNA, 308 bp, Homo sapiens
gaatggtaagattgccagtggatatgggagtgaggcatctagaagatgtctggaattagtaatccctgacatgtacacaggggcatactcagaggatttcagtatcttctctgctgtggttcagtagcaggtgcttgcaccatctaaatcttaccaaagaacgtcatcttgcctcatgaaagttttaggattcctgtcaaccttgagtattctaagttaggggaaagttactttgatacaaaagtgtgggagggaaaagtttagagagggattcagaggaaagagacatgttctaaactatttttgca

SEQ ID NO: 15007 - DNA, 281 bp, Homo sapiens
ccccaagccttcaaccacatcctttgccatgaagcctccggtgcccatttctgggtacctactggacatttctgtgtctagacaagcaccgcaaacaacaaatcgaaaattgaatccagtcctggtctcaaacaactttgcctctggccttttttgccattaccgtgagacggtatctctgtaatcccagctactcagaaggctgaggcaggagaatcacttgaacctgggagacagaggttacagtgaccgagattgcaccattacactctagcctgggt

SEQ ID NO: 15008 - DNA, 963 bp, Homo sapiens
tgcgcttgtctgagatgattcccaatctgtcagccctggtcagtagctcagtaagcaccttgagaatagctcaagtagatctgtaggacccttcttagaagcagtggttcctcatggagaaacttgtgaggctgttacacattctacacacctaacattattttcaaacaaaaatgataattttcagatgcttgacttttaccaaagatcactggaaggcccagtcctaatgttaggggtttgtttaaagtcctttttattttacaatacagagccccagtcaattccacaatctcaatttcatacatgggaattttatttaaaaatctgtggtttggggctttaatgaattggcctgtgaaaatgagctctaaatttcctcccacgtacactcaaaactcaagattgctccaaatctctaagttcttccagcaaaagatttcttggcatgtatattcacttatacttagaaatattcattcttttaatttatgccagaataacaaagtggaaatcttatttcaaaatgctctttgtttttttgtgtgtgtttctgtagttctgctttctggggtagactagtaaaatggtagcttccagcattttgtccctggggccttctttatagggccactcaaatttaaataaaagtagtaaataatttagctaagtggaataagtataataattatagtggtaagcatagcacatcagcattatgccaacattctagactctttagttgatgtcattaaatggaaaagaaacttggattaaatgagtgtgctgctcaccttcccaagttctgttatttcaaacctgtgaactaaccttgcagttcattataaatcaacagtaacaactgcattctaaattactccctgatattattttctagttgtgtatcagcctgtctcctaggggttttcatttccctgaagacatacaagtgccccagagcgc

SEQ ID NO: 15009 - DNA, 517 bp, Homo sapiens
ctccaaggaaactaaatccataatgtggaatatgtgttgtgttcaccaaacaactcagatcagcagagtctggatagaaaaacaataaagagaataaatgtagggagtggtgagagggtccaactcttatcagatatcatgaagtgccagaataaaacaaaattcatagagaatagagactcaccatgaagaaaaaaaaggatatatcttgtttaaaacactagatatgggtcctaaagtgaacagtgaacaaggcatatgcaattaggttcaaggaaggaaatatggtaaagttatataaacaattttacaggttagctgtacatgtggaaagcaatttgtgtcagtggctgaacagatggagaaagatttttagtttctagtgtcctctcctctttccactgtcccacaggaaattctggaagtagctggtgcaagatagaatagcaatatattcatgtagtttatacaaacacacgcccacatatttttgtcacagaattaattctaaaattaa

SEQ ID NO: 15010 - DNA, 134 bp, Homo sapiens
aaattttattttaatcaaattttggtatggaagagagataaatgcccatactagtcaactatcttgaactggaagcatgagcctgactttgaactattaaaatgctaatcagcatgtgattaaacagcacatgc

SEQ ID NO: 15011 - DNA, 345 bp, Homo sapiens
tcagtggagcccacgttgatgacacttcccaagtccacgattccttcagcagactcctaagtcagaccttgctctaaatgttgaacatccagcaacaaatcagatgttccttgaaggggttctcagtgcagtggggggacctagacaagtgctgtcctttataacagcgtggaaagtgcccacaaggcttttgcacgtaggctgtcagggaacaggaacgtgcaaggcacatgccttggcttgagaattcagggaaggctgtgaaagtgaaagtcctgctgagaaaaatctcaaaggatggacaagaactggaatgtggaaaaggagagaaaggaagtttcaggc

SEQ ID NO: 15012 - DNA, 1232 bp, Homo sapiens
gtcatttctccagacctagctggcctgttcagtgggttatctccaccacctcaggaaagctattctgatcaaatttcttcatggcttgtattgaaaacgtccttggagggcacgccccttcacccttggtagtatctgtggacaaaaatgggaaccaggagctgcaccacgacatgcccctgcaatgtctgagttccaagccagaggatgacgcagagccctgggggtcaacctcaagtaccgctgagaccttccgtcaatgtgctgactgatctggatagcaagcaactggagtggccctctgaaagaacaggatcctgcattcctcttcatagcttgagagctcatagacacccctacgggccaccacctgctgttgcagaagagtccctagcaacagcagaagtaaacagctctgatgcactggcaggctggaggcaggagggacaggatgctattaatgtgtcctgggaagtctctggcggccctcctgcactgatagtagggggcacaaaggtcaacaatgggggcactgagagaggcagtaataacgcaaggttgcatgtagctttgccacaaggtaaagggttctttccacccaggggcccacaagtgagaggcccttcacatattcccacccttagatcagggatagtaatggaggtgccgcccggaaatacacgaatagcctgcagaggaaagctggctcatgtttctttcccactcaggggcccatgccaccccatgcataattggccaaggcctatcccgttgtcttccagtactccaggtttaccttcttgctctactgttcattgtttcatccctcctcgacctccgattttcaatccctttctcactatgcctcttccttttgctcctcctccgatatttggtcctccactgccttcttattttgcccatttccattctgggggaatgccagctcctgcatcacccaacagagagcacagctgatggcaaaaaggaaggatgaaaaaagggttgtggaaagaggtgaaagttattcatttatgcttttatatttgaaaccttgtaccctcccacactctgtttagcactaatgtgccctacttgaaaccacgtaccctcccacactctgtttagcactaatgtgccctatttgaaaccttgtaccctaccacactctgtttagcacaaatgtgccctacatactggagattaaataaagattgtgaagtctgaaatgt

SEQ ID NO: 15013 - DNA, 419 bp, Homo sapiens
cggcattccctttccctcattcagcacttctgctgggaactccctgactattccgctgctgcaggaacccagctagctggccaggtggggaggggctggggaccggccaggaaggaggggtgacttcatcccagagagacccgagttcccccagcccttcatcaccaacccgctcctgcaggagtgagtcttacctcccctggccctcctttctggctcagcctgcagcgactgtgaggccacagctcctcagattcactgcccgctgtgtgccagtactcaggcagctggagagaagagaaggcagcagcagaggcccccgccctcaccccagccatctgcacttgtaccatttgctctgtgctgactgtggtcctataaattcatgagaaataaactggttctgtgtgcctctctga

SEQ ID NO: 15014 - DNA, 580 bp, Homo sapiens
ccaaaagtaggaagaatagtctttaaaaaaatttattaagaaaaaactcattctagtacacattttttctcattttctgtatatcattggaaactcaaacaattgggcacagaaatgtaggttcgtatttgggaattattgatttaggtcaccgagctagtaaatggtagaactgaaactaggtcctgcattccgatttctgtgtctcagttttgattattttgagacaccttcagtaatttaagcattgttctttgatttttggctttttaaaatatattggaatttagttagacctgtggttaaaaataagaatagctcctactatttttacatgcttccctagatttttcctaattttggacctatgtggacaaaaaaaaaaatctagtccaagctttcactaccttctttttttattcgccttctgcttctgcgttccacatgggacttgaagtggtttataagaatgcatgctgtgaaatagtaaaaataatttactgatttttaaaaagccctcagaacgcatatgtatatgtatgtatatgaaaaatgtgttagaatcaggaggaaactagcg

SEQ ID NO: 15015 - DNA, 520 bp, Homo sapiens
cacgcaggactggctggggctggcatggcctcttgccagcaaacagcctggttgaaattttttctcatggtccaagatctttccttggaagctttctttcctttcacagctaataaaatggccatatctttcagcagggagttttttctgtttgtttgttttttctatttttaacagaatcatatacaataatgattattttattagaagtcttctgaaataattacttttcaagaaagaatcaattatataaaagtgtagagatttaaaaatatgttacaggttcacaatacaaatactagtagcactaccaataatgaacatcactaattattttctttgtttcatataggaaaggcaagtatgggaggagaaaggtgaatagcattttattgcttgtgaaattttctttctttttttagttctttgccctgtaggtgtttgacagtattttgtatttaggtgagctcaatctaaaaactaagcagattaagtggaatgctatataactagttagaat

SEQ ID NO: 15016 - DNA, 311 bp, Homo sapiens
gcaactctgtgagaaaggtactgctgttcccacacacaggtgaggaagctgaggattccacaggctcccacacttgagaagccttggagccaagacaaaagtgcagccacacaggccttattacatgtcaaggagtttaagttttgttttaagaaaactgaaaagtgcatgggcagctttgagcaggaacgtgatactgtcatgttttagaaagaaagttctgtctacagtatggaaaataaactgaaaaaaggatatgactggagacagagagaccagtcacaagactaagagaaagatgatggaggtca

SEQ ID NO: 15017 - DNA, 417 bp, Homo sapiens
agttcccagtccctctcttacccctaactccctcacagcccttctgttctctccttttggtatctcagaaatcttgggtatcagaaatcatttcataatacaagtaacaaggaataagataacctgttagaagattggattggtttttatatgttacaatttcaggcatatgatttttaaatctgccagagaggtgattgtatactgagtaatatcagtcagcgtactcccctgccagataaaccaggactcagtccgctgctaggatgcgtttcagtgaagacatctgacctgtgtggtatgtcttcagggcattgtagttgacagtagtaatgcaaggatctaccacagcctgtttaaaatatgaccagaaatgtggctgctggagtagctagatgaaatatagaccacactgat

SEQ ID NO: 15018 - DNA, 340 bp, Homo sapiens
cacttgaattgtagttaatgtctttcctgttgttgcctcctgtaccagactacaagttacgtaagagcatgataaatgtttaattcaatcatagttttgacgaagtgttcaattaatatttgtttaactgacaattgttattttaataacaaatttattgactgtgtaaagtgttgtacttattgtttaatgattttttaaggtaactggaaaacataaaggcatgccaggaaattatgcctgatttattatttttccccccaaaatactcgtggcttgtgcatagtatatgttcaaaactgtttattaagttagctgaataatatgtaaatacatatat

SEQ ID NO: 15019 - DNA, 1079 bp, Homo sapiens
  misc_feature (947)..(947): n is a, c, g, or t
  misc_feature (1062)..(1062): n is a, c, g, or t
ctacaacacaccattgagtcttggtcccaaggcgctggtgcacatggtacttcccgaaatccctgtagggccgctggagcaggagccccgatcccacgtttgggcagctgactcgcctaaggcctccagctgaaagcggaattgcaggggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaacatttgtcattatgtcaagttccatgccaatagggactttgcacatgggattaagcacaatggccaggagcagtggcttatgcctgtaatcccagcactttgggaggctgaggcgggtggatcacctgaggtcaagagtttgagaccagcctggccaacgtgcagaacaccctgtctctgctaagggtgcagaactggccggcngccctggccacatctctgctttagctgttggcgcctaggcagagatgcttgagccccaggggaggttgcgggacctgggattgcgccatccactctacgcctcgggaacaagagngaaaccccatctcaaaa

SEQ ID NO: 15020 - DNA, 4123 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15021 - DNA, 3458 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttat

SEQ ID NO: 15022 - DNA, 3858 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15023 - DNA, 3922 bp, Homo sapiens
tccagagtataccccggattgaaataagcacggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaatggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15024 - DNA, 4069 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15025 - DNA, 3948 bp, Homo sapiens
ctacaacacaccattgagtcttggtcccaaggcgctggtgcacatggtacttcccgaaatccctgtagggccgctggagcaggagccccgatcccacgtttgggcagctgactcgcctaaggcctccagctgaaagcggaattgcaggggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaatggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15026 - DNA, 4176 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagctggagtgcagtggcacgatctcggctcactgcaccctctacctcccaggttcaagtgattctgctgcctcagcctcccaagtagctgggattacagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15027 - DNA, 3635 bp, Homo sapiens
actaatgaggaccaccttgtaatttctgggcattttcagagttttctcttccatgtgaattgctccagctaacttaatattagtttctcaagggtttgtgtagacctggctttgtctctttccatctgtttctctctttccctttaacgtcacttgcctgaggtctataaggccctttaaggttgccagcccagagccagaagagattggtgtccctgaagttaagaaagccacctttgcctacagatggtgttcacagtgttggtgtggagtcacagcttgacttttgatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15028 - DNA, 3788 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15029 - DNA, 2043 bp, Homo sapiens
gcatagtcgttctagagtatcccccattgtttgacaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15030 - DNA, 4034 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15031 - DNA, 3992 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtacgcagctcctcactgtagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15032 - DNA, 3980 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15033 - DNA, 2207 bp, Homo sapiens
caattccattccagcgtacaagtccagttcgcagccaattccattccagcgtagctgacataaattcacttgcagctgatggaaaactacttaaactcaactctcgatctacactggccatggattgggacagtgaaactcggagactttactatgatgagcaagaatctgaggtaggtccctcggggttcgtggtcggtggtgtctgctggtttctgctctggatgtggactgcgatcactttcaccagttggacagcaatttagcaagttatatttaagactgagaaggaaaagcacttcaagattttgtcattttatattcagaggctctagaaagtgtactacattccaggtgggagagcctctgtaggccttcatgtcttaatgcagtaagatctctttctccagcagaactgagtgctttgattcccataggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15034 - DNA, 3250 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagttaacccttgagtctttgtaccaggctgtttgtgatcgtatcagccgctatgtgaaacagcctttacctgatgagtttggcagctcacccttggagccaggggcctgcaatggctccaggaacagctgtgaaggagaagatgaggaagaaatggagcatcaggaagaaggcaaagagcagctttcagaaacagaaggcagtggggaagatgagccaggaaatgaccccagtgagaccacccaaaagaagatcaaaggccagccctgcccaaaaaggctttttaccttcagtcttgtgaactcctatggaacagctgacataaattcacttgcagctgatggaaaactacttaaactcaactctcgatctacactggccatggattgggacagtgaaactcggagactttactatgatgagcaagaatctgaggcctacgagaagcatgtgagcatgttgcagcctcagaagaagaagaagaccacagtggccctgagagactgcatcgagctcttcaccaccatggagacccttggggagcatgacccctggtactgtcccaactgtaagaagcatcaacaggccacaaaaaagtttgacctatggtccttgcccaagatcctggtggtccacctcaaacgtttctcctacaacagatactggagggataagctcgacacagtcgtagaattcccaatcagagggctgaacatgtccgagtttgtctgtaacctgtcagcaaggccttatgtgtacgacctcattgccgtgtccaatcattatggagccatgggggttggccactgtaagtattgacatctgcttccttctgagatgttgaaatgtgctcggccatcatctctcaccagtggaccaggcattgccctaaatgctttgcttatgcagtttcacaggcttcatgctgcacgctttcttcatactgattcccctctctgtttttttttaattctttttttttttttttttttgagacggagtctcgttatgtcacccaggctagaacacagtggcgcaatctcactcactgcaagctctgcctcccaggttcacgccattctcctgcctcagcctcctgagtagctgggactacaggcgcccgccaccacgcctggctaattttttgtatttttagtagagacggggtttcaccatgttagccaggatggtctcgatctcctgacctcgtgatccgcccgcctcggcctcccaaagtgctgggattacaggtgtgaggcactgtgcctggctggtttgctctttttttgagacagattctcactctgtcacccaggctggaaagcagtggcg

SEQ ID NO: 15035 - DNA, 1457 bp, Homo sapiens
aatcgagctcggcaccgtaacattcgtgtcaatcattatggagccagggggttggccactacactgcatatgcgaagaacaaactgaatggtaaatggtattactttgatgatagcaacgtgtccctggcctctgaggatcagatagtgactaaagcagcttatgtgctattttaccaacgtcgagatgatgaattttataagacaccttcacttagcagttctggttcctctgatggagggacacgaccaagcagctctcagcagggctttggggatgatgaggcttgcagcatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15036 - DNA, 1205 bp, Homo sapiens
catggatttgctggtgcagtacaactaggcttaatagggacatggacaccaactaatgctgactccacgatcctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15037 - DNA, 1493 bp, Homo sapiens
actaatgaggaccaccttgtaatttctgggcattttcagagttttctcttccatgtgaattgctccagctaacttaatattagtttctcaagggtttgtgtagacctggctttgtctctttccatctgtttctctctttccctttaacgtcacttgcctgaggtctataaggccctttaaggttgccagcccagagccagaagagattggtgtccctgaagttaagaaagccacctttgcctacagatggtgttcacagtgttggtgtggagtcacagcttgacttttgatcaagcactgcgcctagcagaaattttactacctctccaaaatcatcagcaagtccctattcctcagtgtctgccaccctgtagcgccagtgtaatcccccaggagaacatctttgacactctgcagactgctagtgttctgtctaaaaaccagacaaggaaatacccttcttttatgagcagaaggaaacaaaaaaaaaaaagaagaccgtttacctagaagaagctatgtcaagaggctgaattatttttatttttaaacaggtggtgagaaatttctgtgaaacctgtgaagctgaaaagggggtgggatgggggtactcaatggagtatgtctgatggatcccgaagaatggagaggaacacaggcgctgagtatggagcagcctggagacccaccccacctgcagggctgccctgagcgcctggatttctggttctgatgccaatactagtcaccccaagtagtctgctcacagtaacccaaacctcaagtaaactcccctttccctcgctatgtgcactgatatgggtttataattttctgaaagttacccactgaagcccatttctccgttgagtcatcttgtaatttccagctttctccccgctaaggaagatatctagtgttggggatcctggcccctcaacctcctgtggaacccagcagttctgttatatcccctgctaccctagatgaattaagacggttaaatactgtgtggaacttttattagataacacactttttattagataacgcttaaaggaagtcagtacataaaactgcccggtgctgtgtcccgtctagttgtttccatgttggcttgagaacagaaatctttgtgggagttagccgggaaagggctccagttcatggcgatttagggtagtaatacattttggtgttacccagatgctttctagaacgggttctttcctcatccctgccaagactcttcccggggcccccattcgaaagccccgtccccactcccaccgcggggccagccgctgcgtgtgggcaaggccttaaggaaccggacgtatgggtccgggattttttgtctgaccttcaacctaatccgtgggggtttggggcctgcgcggggcacgcgcatgcgatgaccgttggatgggtcggcgtcactgcgctgcgggtgaggacaaggacgtggctgccgactcgccaaagggggggtg

SEQ ID NO: 15038 - DNA, 2131 bp, Homo sapiens
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaaatcaagcactgcgcctagcagaaattttactacctctccaaaatcatcagcaagtccctattcctcagtgtctgcctctctcattgcaaatggtgatagcactagcacctgtgggatgcacagttccggtgtcagcaggggtggatctggcttttctgcttcgtataattgtcaggagccaccatcctctcatatacaacctgggctctgtggacttggaaacctgggaaacacctgcttcatgaactccgctttgcagtgtttgagcaacactgcaccactgactgactactttctcaaagatgagtatgaagccgaaatcaacagagacaaccctctggggatgaaaggggaaattgcagaagcctatgctgaactcattaagcagatgtggtctggaagggacgcccatgtggcacctcgcatgttcaaaactcaagtaggacgttttgctcctcaattttctggctaccagcaacaagattctcaggagctgctggcctttcttctagatggattgcatgaagatctgaaccgggtaaagaaaaagccctacttggagctgaaggatgccaatgggcggccagatgcggtggtggcaaaggaagcctgggagaatcacaggttgaggaatgattctgtgattgtggatactttccatggcctcttcaaatctactttggtttgcccagaatgtgctaaggtttctgtgacctttgacccattttgctatctaacgctgccactgcccttgaagaaagatcgagttatggaggttttcctggttcctgctgaccctcactgcagacctactcagtaccgtgtgactgtgccgctgatgggggctgtgtccgacctgtgcgaggctctctccaggctgtctggcattgctgcagaaaatatggtggtcgcagatgtgtataatcaccgattccacaaaattttccaaatggatgaaggtttaaaccacatcatgcctcgggatgacattttcgtgtacgaggtctgcagcacttccgtggatggctcggaatgtgtcacgcttccagtctacttcagggagaggaagtccaggccatcaagcacttcctccgcatcagcgctatatgggcagccactattgctttctgtccccaagcacaagctggagtgcagtggcacgatctcggctcactgcaccctctacctcccaggttcaagtgattctgctgcctcagcctcccaagtagctgggattacaggcatgtgccaccacgcccagcctccatgctgttcttaagaggccttcattgcaggcctataggcagaagcaggaagcggcagaagcaggaagcgcagaacaggagggccgacc

SEQ ID NO: 15039 - DNA, 1113 bp, Homo sapiens
  misc_feature (981)..(981): n is a, c, g, or t
  misc_feature (1096)..(1096): n is a, c, g, or t
agcgtgcgtgcgtgggcgcggtctatagcacgccgcgcgcggggcggatgtccgggccggctgggccggggccgcggaggagatggcggaaggtggaggctgccgtgagcgaccggatgcggagactcagaagtccgagcttggacccttaatgaggaccacactccaacgcggggcgcagtggtatcttattgacagccggtggttcaagcagtggaagaagtatgtgggctttgacagctgggacatgtacaatgtgggtgaacataacctatttcctggcccaatagacaactctgggctattttcagatcctgagagtcagaccttgaaagaacacttaattgatgaattggactatgtattggtccctaccgaggcgtggaataaactactaaactggtacggctgtgtagaaggccagcaacccatcgtcagaaaagttgtggagcatggcctgtttgtcaagcactgcaaagtcgaggtgtatttgctggaactgaagctctgtgagaacagtgaccccaccaatgtgctgagttgccatttcagcaaggcagacaccattgcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtgctagtaattgagcctcaaaatgaagatggcacatggcccaggcagaccttgcagtcaaacatttgtcattatgtcaagttccatgccaatagggactttgcacatgggattaagcacaatggccaggagcagtggcttatgcctgtaatcccagcactttgggaggctgaggcgggtggatcacctgaggtcaagagtttgagaccagcctggccaacgtgcagaacaccctgtctctgctaagggtgcagaactggccggcngccctggccacatctctgctttagctgttggcgcctaggcagagatgcttgagccccaggggaggttgcgggacctgggattgcgccatccactctacgcctcgggaacaagagngaaaccccatctcaaaa

SEQ ID NO: 15040 - DNA, 329 bp, Homo sapiens
tcaatcaatcaatataatatatatttgaaatatgtatatatataaacatatatgtgaaatatatatatgtgtgttggggtggggattgggcgtagagctggcatgtggtatgagtatgatacactaagagtagtcctggccttgtttgtcctggatcaagctcttggctgtacagattgccacctgattcatctccaggtttgctgtgagtcattctggatgcaggggcaaggggctgagaggtgttgagaatgtcctgtttatccctttgacgcaggtggtggcaaaggaagcctgggagaatcacaggttgaggaatgattctgtga

SEQ ID NO: 15041 - DNA, 593 bp, Homo sapiens
ggccgaagtaggcggatcacctgaggtcaggagtttgagaccagcctgcccaacatggtgaaaccccgtctctactaaaaatacaaaaattagctgggagtggtgacaggtgcctgtaatcccagttagtcaggaggctgaggcaggagaatcgcttgaacctgggaggcagaggttgcagtgagccaagattgtgtcactatactccagcctgggcgacagaacaagactccgtctaaaagaaaaaaaaagaaagactgcatttaaataagcattttgaaaccacttgttttctttcttttattcactctttgaacaatcatttcacttaatggatgcataccctgggccagactctctgtgccatgtggggcctgggccctgctcttgctcttgtgacagtgttttttagtgggtattgcatatgccccaagtggaaggaccataaaaaagattaaggaagcagctgcagaaatttataatctcagcttttctgctacagtaaatttctgtctctctctaggtatcttattgacagccggtggttcaagcagtggaagaagtatgtgggctttgacagctgggacatgtac

SEQ ID NO: 15042 - DNA, 697 bp, Homo sapiens
gagagacacacgttagcaaagaagcatagggatactttccaggcatatgagtgcaagaggccacccatgggagatgattgattttaagaggtatcagggggttgatccagagcacctgtgagcatctgacaagaaagaggatgagcattagtttgccatggctgtctttagccttgcatgtggacaaagccccaagtgatatttctgcctgttcctagcaaccatcgagaaagagatgcggaagctattcaacatccctgcggagcgtgaaacacggctctggaacaaatacatgagcaacacctacgagcagttgagcaagctagacaacactgtccaggatgctgggctataccagggtcaggtaggagggccctggccattccccagcaggtagctctgcccagggtgtgtggccagatactttttgcttctaagcatgttggaagtgcggtggtttgaactctcctcatttggtttcccctttcactcaggtgctagtaattgagcctcaaaatgaagatggcacatggcccaggcagaccttgcagtcaaagtaagtgaattttttctcccttgtgtaggctcacatgtgcaaaagagacagtctttcctaaggcagtacttgtactaagaattgttctgattcagatgaacaatgcctattttgtatatccagagttcatgcttctggatg

SEQ ID NO: 15043 - DNA, 503 bp, Homo sapiens
gggctgttatgtacaggaggattcctccagctgatgaaagtattgtttgtaatgtccttatggagtttaagactctgaaccaaagaaggacatgttggagagggattcatgtcagtacttgggtgtggttactcagggtactccacccttcctccttaggacttagggcagtggcccaggttccaggttcatcctcctggctctctgatctaggccttctttctggtgggaaccactggcctcctgtaggctcttcaggagttaattggactactcaaccaagtgttctctctcactgccccagctaactcctcagagctatttttgatggcaattcttttttgatttaactagttctttacgtattatgccttctgatacagttgcttttgttgtagactcaagtaggacgttttgctcctcaattttctggctaccagcaacaagattctcaggagctgctggcctttcttctagatggattgcatgaagatctgaaccgg

SEQ ID NO: 15044 - DNA, 7339 bp, Homo sapiens
  misc_feature (1985)..(1985): n is a, c, g, or t
  misc_feature (2205)..(2205): n is a, c, g, or t
  misc_feature (3134)..(3134): n is a, c, g, or t
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttgtcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgngaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcntgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccanggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttataaaaaa

SEQ ID NO: 15045 - DNA, 7276 bp, Homo sapiens
  misc_feature (1985)..(1985): n is a, c, g, or t
  misc_feature (2205)..(2205): n is a, c, g, or t
  misc_feature (3134)..(3134): n is a, c, g, or t
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttgtcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgngaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcntgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccanggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgataaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttataaaaaa

SEQ ID NO: 15046 - DNA, 338 bp, Homo sapiens
gggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaagtaagtaaaataaaaatgcagtattcatttttgcacta

SEQ ID NO: 15047 - DNA, 485 bp, Homo sapiens
catggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcaggcccttataagggcactaatcccattcatgagcgctccaccctcacgacctaatcacctccaaaaggccccatttcataataccatcaattaagtttcattatatgactttgatggggatatagcccatagtaggttctatgtccctgaaa

SEQ ID NO: 15048 - DNA, 557 bp, Homo sapiens
ataatcggtgtacttgaggaagaagagaattctaaaagcctggaaagcatatttgggggaataatcgagaaaaacttccccggtcttgcaggagacttcaacatccaaatataagaagcacaaagaacacccaggaaattcatcacagaaagatcattgcctaggcacattgtcatcaggttatccaaagttaagacaaaggaaagaatcttaagagctgtgagacagaagcaccaggtaacctataaaggaaaacctatcagattaacagcagatttctcagcagaaaccctcaaagctagaagggattagggacctatcttcagcctcctcaaacaaaacagttatcagccaaaaattttgtatccagtgaaactaagtatcacatatgaaggaaagatacagccattttcagacaaacaaatgctgagagaatttgccaccaccaagctatcactaaaagaactgctaaaaggagctctaaatcttgaaacaaattctggaaatacatcaaaacagaacctctttaaaacataaatcacacagatctataaagc

SEQ ID NO: 15049 - DNA, 228 bp, Homo sapiens
ctactgagcgaggccctctaccccgagctgcatggctgtggagatgcctttgacaaaggatcgctggctagctagtgctggggttcagaggagagccatgtttctgcactaactgaaggctcccctgtggccagcactgttctgggtgtggcaggctggccccccggcaggagagagctgcccgaggccctgctctcctgcagcttgcattccccagtatgggacatg

SEQ ID NO: 15050 - DNA, 184 bp, Homo sapiens
gacctaatgcatggtgactatagggaataataatgtatatttgaatttgctaagacagtagaccttatgtgttctcaccacacacacacaaatggtaactacactgtaaggctcttttagaatttatctagcaagttttcttgtttttaccagaaaactcctcaaaaaaaagggaattgtatga

SEQ ID NO: 15051 - DNA, 335 bp, Homo sapiens
  misc_feature (118)..(118): n is a, c, g, or t
  misc_feature (138)..(138): n is a, c, g, or t
  misc_feature (170)..(170): n is a, c, g, or t
  misc_feature (199)..(199): n is a, c, g, or t
tggtagagacggggtttcaccatgttggccaggctggtcttgaactcctgacctcaggtgatccgcctgccttggcctccccaaagtgctgggattacaggcgtgagccaccatgccnggcctctttctcacctttanacctgtcttcttatcctcacatctgttttcanaccttcatccctgtcttcctcatgttcanacttgtcttccccatgttcatagctgcctttcttaccattttggtttgaagggcagtcttctctggcttgtttttttgtttttcccagaaaatcagtattattttttaaataagaaaaacattcctaaaaaaaaaa

SEQ ID NO: 15052 - DNA, 155 bp, Homo sapiens
gattagatggtatatacttattagacataattaacaggacacattttgtagctattattaaaatagaaacagaataaattaggctttcccaagccctgattatcttttcctttctttttcttcttttttcttaaaaacaaacaaacaaacaaaca

SEQ ID NO: 15053 - DNA, 372 bp, Homo sapiens
gtcagtcttttgcttgccctggctggtatcactgttttagatagctatgatgttaagtaattactgctgattgttttctacaaaaccccaggatagtgagttctgagtctggtaaaatataggctctgtgaatggggcttttcctgggagctgccagacaggtcaaaagtgagatttttctagagattggatttttggggaattccagacctattctacctgtccagtggatactagattactggttttcacagcaactgtctttgggcagcgtttggattttaagtttatgatagagctaaggagaaactgaaaggtcaagggcaagttcaaatgccacaaagtttacttctcttactgaaaatcaacctt

SEQ ID NO: 15054 - DNA, 520 bp, Homo sapiens
atcacttttgttacttacttttagggtacttttaaacacatcaattaacagagtaaaagaattcatattatcattcagtaggggcaactttcattacttctctttaggatattttggcaatctaactgtctccttgccaccgagatattcatcccatataccctcataagctttctgaaacacacactttatagcatcacctctctgctcaaaaaccttcagtgatgtccagctttctctgcaggtctttgaggcaccacaagatctggagctacgtacctttccaggctcccaactcttcctctgccctggtactatccctgtcccctcccatcccaggtcagagtatgaggagctcctgactcccttctttactcagtgaaattctacttaacattcaagatcctcagtaaaaaaaagaatcacctcctctcataagaaccctctaatctttccagttggaaaaaatcctgcttccatttatactctactcccaattgtaagttttaataaagtttac

SEQ ID NO: 15055 - DNA, 440 bp, Homo sapiens
tctggctttgccagtcgataggtatgtgaccctaggcaaattacgtagacactgagaaccagtttcttagggttattgcaaagaagaggcaagataattcacataaagcacacgaaatgcgttgggagcagtctgtagaaggtagctgttattattagggaaggaaagaggaacagagtgaaaggagggttgctggtaggattgggcagctagaaggatgagcaggtgggagagcccactgatagagtcctcactggctcagggtttacggagagaaagaaatgtgaggatggagagatagaggaacacatggaggggcaaggccctgcctcaggtgcaccgttcgatgccagtccttggtcctggtcactgggtagataaaccccccatgccttcccctctgcttcttccccaactcagtgtatcccattctaccaggt

SEQ ID NO: 15056 - DNA, 2409 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatg

SEQ ID NO: 15057 - DNA, 2175 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatg

SEQ ID NO: 15058 - DNA, 1063 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttttgctctgttgcccaggctggagtgcagtggtgtgatatggctcactgcagccttgacctcccaggctccagagatcctcccacctcagccacctatgtggctggtattgcagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgcggatcatggatcctccagatgtttcaagaaaaacttttcccgggtcccgcgaaa

SEQ ID NO: 15059 - DNA, 2584 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacaggtgggttcttggtctcgctggtctcgctgacttcaagaatgaagccgaagacccttgtgggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaataaatccatgttttagcaaaag

SEQ ID NO: 15060 - DNA, 1761 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactggccaagtcattaacctctcgacctcatcga

SEQ ID NO: 15061 - DNA, 757 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagtcaaataggccggatgcggtggctcacgcctgtaatcccagcactttgggaggctgaggcgggcggatcacgaggtcaagagatccagaccatcctggccaacatggtgaaaccccatct

SEQ ID NO: 15062 - DNA, 2525 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaataaatccatgttttagcaaaag

SEQ ID NO: 15063 - DNA, 1255 bp, Homo sapiens
  misc_feature (1116)..(1116): n is a, c, g, or t
  misc_feature (1119)..(1119): n is a, c, g, or t
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacctggccaggnaancaacctctcaatagatctggcttttttccagggagtgcctggatcttggttggggtggacgtccatttctcccccccgggactggtcccgtcagctgtctttcctcccgtggggcccccgttgttttcgccgggcc

SEQ ID NO: 15064 - DNA, 2183 bp, Homo sapiens
taggctaggtacgaggccgggtggtgcaggttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaataaatccatgttttagcaaaag

SEQ ID NO: 15065 - DNA, 2642 bp, Homo sapiens
cctggagtgaagggcacaagatgcttttattttaaacccctaaaagtgttgcaaagtgtttttaatttcatataaatagttaaggatcacatgaacacaatccagtacaaatgggtccaggagcttcaacgagcgttccagcttcttcgtaacgttcccacaccgtgcagcaagcggagggaagagaacttccggcgcccccacctaccgctccccagccgtgtcccgctgctctaaatctgcagacttgatcgattgcttctgcctgggcggtaccgcccgaattgactgctcctgtctgatgcgtccccgggcgcgggaaacgagtttcaatccactttcctgaccccaaccatcctgcccagtctccgcttccccgtcttgtacacccctaactcctgaggctcctccgaatcacgcgagtggaagcggagaagctcaagtggccgccatgtcagaggcttatttccgagtggagtcgggtgcgctggggcctgaggagaactttctttctttggacgacatcctgatgtcccacgagaagctgccggtgcgcacggagaccgccatgcctcgccttggcgctttcttcctggagcggagcgcaggcgccgagactgacaacgcggtcccacagggttttgctctgttgcccaggctggagtgcagtggtgtgatatggctcactgcagccttgacctcccaggctccagagatcctcccacctcagccacctatgtggctggtattgcagggttccaagcttgaactacccttgtggctggcaaaaggactttttgacaacaagcgacggatcctttctgtggaactccccaagatctaccaagagggttggaggactgtgttcagtgcagatcccaatgtggtggacctccacaaaatggggccccatttctacgggtttggctcccagctcctgcattttgacagtcccgagaatgcagacatttcccagtctctgctgcagacttttatcggacgttttcgccgcatcatggactcctcacagaatgcttacaacgaagacacttcagccctggtagccaggctagacgagatggagaggggcttatttcaaacagggcagaaaggactgaatgactttcagtgttgggagaaggggcaggcttctcagatcacagcttccaacctcgttcagaattacaagaagagaaaattcactgatatggaagactgaaagccggaagaacacagaatggctcctcacagacgtatccctccgtgtgtccttgataggagctggttgaccttgtacagaaccagaatcctgtcccatttcatggcttatttcctgtggccatagagaattatagggaactggacatgctggaggatgtgggtgtccctggctctgtgagtcttccaggaccgtcccaccctgctgacccacagcccaggccctttaacccaagaacccatggccaaggagaaatcaaagtccttcctaaataagaatcactgccatataatatatcacagtagagttgcaactgagattccttgtgtctgggagtttggacagcttcagatgtacagtttcactagccacaaagcacaggtacaaactgggtcatcgcctgttcacaaaatgctctcttgatcttatttgcctcatcttcctcatggttgtacagaggatagcaccccaccatgccagcctgacttggagatatctcctgctgcctgcctgcagggagttaccccagtttccaaaaacagtcgcccagataaaggaggaaaagggaaaggcagacgaatggcatggcttttactaaagaaaagatgttggcctcatactctatactcagggcttaatgaactggaatctgcataactcagcagtcaacccagaagggaaatggttaaactgagcttgttattgcctcggagagcctaagagcacccgcacacttaattctactccctgtctagaaaagctgtcagggagtcgtttggaattgcaatgtagttattaagggctgttaaccagcctgcattacatctggaagtcaggacttgggtgctgactatgaagggccctgttttcaaaatctaacattgcaagtgtaaatgggcaagaagcctccgttgtgctttttttttcctcttcagtaacttttgcaacattattgcatagaagatccctgaccatttactaggaacctggttaagcaagcactaatctcttttcctggagatcaaggatgcaacctcaggttgagaaagaaacagggttccctgggcccattagactgtttgcagggcatcactgcttccccctgacacctcacaactagcaaaaattgtctttgtctttggaaattatagagggatttgggtatccagattgtgcagatgcaaacttaggctgtcttgatgcaaacttagaaccacagaaatgcttttaaaatgcctgttttaagatggaattgttgtttttataatttgattttagtgctaaataaatgattggctttgtacatgaatatgttctgtacaagtgctctttcactagtactacagataatcaaagctatcagaattgtgtctttgatcatatttgacggtaatacacaaataaatccatgttttagcaaaag

SEQ ID NO: 15066 - DNA, 935 bp, Homo sapiens
cggaacgcgtgggtcgacccacgcgtccgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattataccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttgtcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaagtcagaggagatgtagcatttagaacaccttgagacatgacattgtaaaatagcttgttttatgttcctgaagctatcttgttctctgttaaagctactaattgtctcagtgtaagttttaaataaacatatttcttaaaaaacaaagagaaaataacagaacaaaaaaggggggggctaagagtacccggggcacaaatgctgaccagttttgtaaagggcccagggagggtataaagggaggggggaaacagaggggaaggtgtgttggggagctttgggagagggaacgaagggcgggaaaag

SEQ ID NO: 15067 - DNA, 1597 bp, Homo sapiens
  misc_feature (1540)..(1540): n is a, c, g, or t
  misc_feature (1559)..(1560): n is a, c, g, or t
gcaggtgtgtaccaccacgcccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaaggactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgtttttttgttttttgttctcagagttgtcttctgagataattattaccaagtcatttgtggggttgtgtttttttcacatcatgtgacagaaattataactcataagatttaggcataatctggttttaaaccttgattgaaactgttgttttttaacttagcaggcagcctaggccatggctgaaaagaaggggtaagtccttcattgcatgatgatgtgtgcaggttttcctgattttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatactgtttttggtaatgtaagcagttaaaaacatgactttagaaagacagcttaatgcgtattcaagcaaacctttggttgggggtttnctttggtggagagaggagnnttttcccggaatagttttgcttgggggggctcttttt

SEQ ID NO: 15068 - DNA, 1223 bp, Homo sapiens
gcaggtgtgtaccaccacgcccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaaggactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgtttttttgttttttgttctcagagttgtcttctgagataattattaccaagtcatttgtggggttgtgtttttttcacatcatgtgacagacatcttaccccctccgtttacgcctcccctccgcttcttctaaccacccccccgctcctctcttctccccttacctcccctgccctcctccccgtccccctcctcttttcgccttccacccgtctccttcccatcacccttctcccccctctgctgtaccgcccc

SEQ ID NO: 15069 - DNA, 462 bp, Homo sapiens
gtgactcttagagtgatccccaattactacaacaccaattttatttgcacatttactttgatattctttttcattttttattaaatgattggttttggcaagatctgacttctgcattgagccctcatctgcaggaggcatgtgcaatagtgagactgaaatttgaatgaaaacactcaatatttcagcaagataatttgagaatgtttgcattgatattttcttatgtttatctagaaatgccagtttccttcctagaagatgtgactgatgagaaattttttactggctcatgcattttttgaatatttttcattagcagctgtttatagactttaagccttcaatctgaggtgacggtagttggcaaaagtatagatctttagctaattgactaaatacagagcaagttacatgtgtgaactttgtttctctaagaagaaaagtattagtgtagactgg

SEQ ID NO: 15070 - DNA, 3219 bp, Homo sapiens
gcaggtgtgtaccaccacgcccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaaggactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgtttttttgttttttgttctcagagttgtcttctgagataattattaccaagtcatttgtggggttgtgtttttttcacatcatgtgacagaaattataactcataagatttaggcataatctggttttaaaccttgattgaaactgttgttttttaacttagcaggcagcctaggccatggctgttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatactgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttaagtaacacatcccacttacagttgtttgcatgattagtcttgtgtatcatgatgttcaactttgcttttgctgtgccagttcaaaaatatcttttttgctaaaaactcttaaaattcatgacataagttttgttttgatcacccggttttatatagtatttctgggaccaaaaaatttaaatatacctttttaatataaaacagaagtttgaagctggaaagatagtgtttatggaagatttgtgtgcttttgtgttttttaaacccgtcaggctgctggtaaggcagtttctagggctcacttttcctccttacctcttgactagtgtagcatgtggtatgtttaaaatatttcattttctgcttcgtaattctaaggtcaacactatactgtatgtagacaggagagctgatttgtatatttagttatttggtctaatcaagcataactaaagggacttcttttttgatacttttctcaaattaagtttaaatatagtatacgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattataccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttgtcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaagtcagaggagatgtagcatttagaacaccttgagacatgacattgtaaaatagcttgttttatgttcctgaagctatcttgttctctgttaaagctactaattgtctcagtgtaagttttaaataaacatatttcttagctagaaataagagataagttaagaaagaaaaaacattttggggcgcggtattggcgtagaaagaaagtttgtctaaacacccagctggtaagtggagcggaggccgcgtacaagtatgtagcacagtggcccacaagaagtaaccacgaaggaaacatccgggcgtccatcgacggagcgggtccccgcacgaataaaaagccgggtgggggaacggtagtctttaaagcagaccacgaataggggtccgacggccacacgggctcgttaacgagcggcagaggagacgataaaacccccggggggaacagag

SEQ ID NO: 15071 - DNA, 3073 bp, Homo sapiens
gcaggtgtgtaccaccacgcccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaaggactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgtttttttgttttttgttctcagagttgtcttctgagataattattaccaagtcatttgtggggttgtgtttttttcacatcatgtgacagaaattataactcataagatttaggcataatctggttttaaaccttgattgaaactgttgttttttaacttagcaggcagcctaggccatggctgttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatactgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttaagtaacacatcccacttacagttgtttgcatgattagtcttgtgtatcatgatgttcaactttgcttttgctgtgccagttcaaaaatatcttttttgctaaaaactcttaaaattcatgacataagttttgttttgatcacccggttttatatagtatttctgggaccaaaaaatttaaatatacctttttaatataaaacagaagtttgaagctggaaagatagtgtttatggaagatttgtgtgcttttgtgttttttaaacccgtcaggctgctggtaaggcagtttctagggctcacttttcctccttacctcttgactagtgtagcatgtggtatgtttaaaatatttcattttctgcttcgtaattctaaggtcaacactatactgtatgtagacaggagagctgatttgtatatttagttatttggtctaatcaagcataactaaagggacttcttttttgatacttttctcaaattaagtttaaatatagtatacgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattataccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttgtcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaagtcagaggagatgtagcatttagaacaccttgagacatgacattgtaaaatagcttgttttatgttcctgaagctatcttgttctctgttaaagctactaattgtctcagtgtaagttttaaataaacatatttcttaaaaaacaaagagaaaataacagaacaaaaaaggggggggctaagagtacccggggcacaaatgctgaccagttttgtaaagggcccagggagggtataaagggaggggggaaacagaggggaaggtgtgttggggagctttgggagagggaacgaagggcgggaaaag

SEQ ID NO: 15072 - DNA, 3273 bp, Homo sapiens
gcaggtgtgtaccaccacgcccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaaggactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgtttttttgttttttgttctcagagttgtcttctgagataattattaccaagtcatttgtggggttgtgtttttttcacatcatgtgacagaaattataactcataagatttaggcataatctggttttaaaccttgattgaaactgttgttttttaacttagcaggcagcctaggccatggctgaaaagaaggggtaagtccttcattgcatgatgatgtgtgcaggttttcctgattttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatactgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttaagtaacacatcccacttacagttgtttgcatgattagtcttgtgtatcatgatgttcaactttgcttttgctgtgccagttcaaaaatatcttttttgctaaaaactcttaaaattcatgacataagttttgttttgatcacccggttttatatagtatttctgggaccaaaaaatttaaatatacctttttaatataaaacagaagtttgaagctggaaagatagtgtttatggaagatttgtgtgcttttgtgttttttaaacccgtcaggctgctggtaaggcagtttctagggctcacttttcctccttacctcttgactagtgtagcatgtggtatgtttaaaatatttcattttctgcttcgtaattctaaggtcaacactatactgtatgtagacaggagagctgatttgtatatttagttatttggtctaatcaagcataactaaagggacttcttttttgatacttttctcaaattaagtttaaatatagtatacgggccacatttcatgtctttgaaagtgttgtacattactgtaaaccaagtactctgtctacaccagagggtgctttaactgcaaaatatttgagaaacaattcagtctctcaaacattttggcacagttcatcactccagtttgttactttcttgagaatagtccattttttgtttttgttattataccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttgtcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaagtcagaggagatgtagcatttagaacaccttgagacatgacattgtaaaatagcttgttttatgttcctgaagctatcttgttctctgttaaagctactaattgtctcagtgtaagttttaaataaacatatttcttagctagaaataagagataagttaagaaagaaaaaacattttggggcgcggtattggcgtagaaagaaagtttgtctaaacacccagctggtaagtggagcggaggccgcgtacaagtatgtagcacagtggcccacaagaagtaaccacgaaggaaacatccgggcgtccatcgacggagcgggtccccgcacgaataaaaagccgggtgggggaacggtagtctttaaagcagaccacgaataggggtccgacggccacacgggctcgttaacgagcggcagaggagacgataaaacccccggggggaacagag

SEQ ID NO: 15073 - DNA, 1329 bp, Homo sapiens
gtgactcttagagtgatccccaattactacaacaccaattttatttgcacatttactttgatattctttttcattttttattaaatgattggttttggcaagatctgacttctgcattgagccctcatctgcaggaggcatgtgcaatagtgagactgaaatttgaatgaaaacactcaatatttcagcaagataatttgagaatgtttgcattgatattttcttatgtttatctagaaatgccagtttccttcctagaagatgtgactgatgagaaattttttactggctcatgcattttttgaatatttttcattagcagctgtttatagactttaagccttcaatctgaggtgacggtagttggcaaaagtatagatctttagctaattgactaaatacagagcaagttacatgtgtgaactttgtttctaatagtccattttttgtttttgttattataccgtatgttctggtcattggaaacagaacagctcatagttgggtgatgtaatataataacagtaatataacctagtagtcattttgcttcaagtaatttaattagatagcaaaatcactgcggtttgtttattacacttgtagggctttttgtcttactcagtgaccatcactacgaatgtcttacattgaagcacagactgcagagcacttgttaacttagtcctcctgcataatgcactcgtgaaaagtagtgcttgctaggtgtttgaagattttatgatccgtgtgcttgggctcgttgagttatttgtaaaataaacatttagtttgagttgatgcagtaagttttttggactagtagtatccaggtccctactctactgaaaatataatcttcactatctccccttaagtcagaggagatgtagcatttagaacaccttgagacatgacattgtaaaatagcttgttttatgttcctgaagctatcttgttctctgttaaagctactaattgtctcagtgtaagttttaaataaacatatttcttagctagaaataagagataagttaagaaagaaaaaacattttggggcgcggtattggcgtagaaagaaagtttgtctaaacacccagctggtaagtggagcggaggccgcgtacaagtatgtagcacagtggcccacaagaagtaaccacgaaggaaacatccgggcgtccatcgacggagcgggtccccgcacgaataaaaagccgggtgggggaacggtagtctttaaagcagaccacgaataggggtccgacggccacacgggctcgttaacgagcggcagaggagacgataaaacccccggggggaacagag

SEQ ID NO: 15074 - DNA, 1892 bp, Homo sapiens
gcaggtgtgtaccaccacgcccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaaggactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgtttttttgttttttgttctcagagttgtcttctgagataattattaccaagtcatttgtggggttgtgtttttttcacatcatgtgacagaaattataactcataagatttaggcataatctggttttaaaccttgattgaaactgttgttttttaacttagcaggcagcctaggccatggctgttctaatttttatttttgaattcacatgtgtaatttcacatcaataacttgtgtttctgaaatatcctaactaacttgttaataaggaaagaaaccagatttgcttaaatctgttcaaggctgacattctgaaattctaaactggaaataacttcccagagtatttggaaaggttctaagtacaaggatcaggcctaaaatagctccttgggaaagaaatttcctttttgatgagaaaacttaaaatactgtttttggtaatgtaagcagttaaaaacatgactttagaaagacagcttaatgcgtattcaagcaaacctttgttttgttgcttttgcttttgtttgtagaagagagaggaagttattataccaaaaagtaatagtatatgtaactttgagtgaggctacttatatcttagaatgggtatccttgaactatatctaccccaccatggcttaaaaaaatcagtggtatatattgagaatgtcagtcatgagcttagtgtttttttcacatcatgtgacagaaattataactcataagatttaggcataatctggttttaaaaccttgattgaaactgttgttttttaacttagcaggcagcctaggccatggctgaaaagaaggggtaagtccttcattgcatgatgatgtgtgcaggttttcctgattttctaatttttatttttgaattcacatgtgtaatttcacatcaataacttgtgtaaactgatt

SEQ ID NO: 15075 - DNA, 378 bp, Homo sapiens
aacgagttatgactcctttgtcttgaggacttacgttttgaacatgctttaagcaccaattttatttgcacatttactttgatattctttttcattttttattaaatgattggttttggcaagatctgacttctgcattgagccctcatctgcaggaggcatgtgcaatagtgagactgaaatttgaatgaaaacactcaatatttcagcaagataatttgagaatgtttgcattgatattttcttatgtttatctagaaatgccagtttccttcctagaagatgtgactgatgagaaattttttactggctcatgcattttttgaatatttttcattagcagctgtttatagactttaagccttcaatctgaggtga

SEQ ID NO: 15076 - DNA, 3011 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccggtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggcctcggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaa

SEQ ID NO: 15077 - DNA, 605 bp, Homo sapiens
tagggaaatttggccctgaggcccaaaaattcggccacgaggttcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaa

SEQ ID NO: 15078 - DNA, 3168 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggtgagtggaaggggcgtgctgcagctccgctggggcgtgggggcggctgcgggccctgcgcgcacgtggacaaggagcacactctctgaggcccccagcagggaggcagaggtggcggccgcacggacttcggttcggggctcaacacgcacaccaggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccggtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggcctcggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaa

SEQ ID NO: 15079 - DNA, 3379 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccggtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggcctcggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgtggcccctttggcccaagccattttaaaactgaaaaaatttaatcattcggcccaaatttgagccaaattggccaaatccccctaaaaggggccgatttaaaattcaatggcccgcttttaaaaaccgcggaactggaaaaaccctggggttacccaatttaaaccccttgaaaaaaaacccctttttccaaagtgggaaaaatcccaaaaggccccaaccaaacgcctcttcaaaaaattcccccttggg

SEQ ID NO: 15080 - DNA, 2158 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagtgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaa

SEQ ID NO: 15081 - DNA, 745 bp, Homo sapiens
  misc_feature (14)..(15): n is a, c, g, or t
tgaaccccctagtnnagaagttcaatagcagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaa

SEQ ID NO: 15082 - DNA, 1904 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgtggcccctttggcccaagccattttaaaactgaaaaaatttaatcattcggcccaaatttgagccaaattggccaaatccccctaaaaggggccgatttaaaattcaatggcccgcttttaaaaaccgcggaactggaaaaaccctggggttacccaatttaaaccccttgaaaaaaaacccctttttccaaagtgggaaaaatcccaaaaggccccaaccaaacgcctcttcaaaaaattcccccttggg

SEQ ID NO: 15083 - DNA, 1536 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaa

SEQ ID NO: 15084 - DNA, 1041 bp, Homo sapiens
aaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagagagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggtgagtggaaggggcgtgctgcagctccgctggggcgtgggggcggctgcgggccctgcgcgcacgtggacaaggagcacactctctgaggcccccagcagggaggcagaggtggcggccgcacggacttcggttcggggctcaacacgcacaccaggtatggtgcgcttcacctggcctcgggaagcacttggtgcgtctccctcggctcccgtttcgaaatcgtggcgatgtattttggaggatttggggggaaatccaccctgttggcactattaggtcggtcctctggggcgttccgcggtggagggacgaggtccccggggatgctgtgaaggaggagtgcccacctcgggctgggcaggtgggtgagcgccacttcctggcgccggcgccctcattccatctgctgccgagccagccagactgggcgcggtgattcaagagttgaccgaagtgagaaatcctggttaagttttgtgctgctgccgggtgggagaccagagccggctctctcttcctgggcctgagcgaggtgatatagccacccccagggctggggtccagggaagcctgtttgtggtatcactatgctctgtgcgaagtagggacaaatgtttttaaggagtgggcagcgactctagaaagcgtttctgtggttgctg

SEQ ID NO: 15085 - DNA, 652 bp, Homo sapiens
tcaggactgagactagggtgaggcaagagaggcatcagaatgcaaaagtgaagtagacacctgccgtcagcactgggcagccctgctcctggggccttacttgactcatcctggtgggttttccaaatggcagaggtgcacaaccacttcttgcaagcatgggcacttgaattgtagcccatgtacacagtgattcttggaaaaagtcatgagtaatgaatggaacttttctctcccaggttgatcttgtgttttgagacataaagagtcaaaggttggtgcctagggatgctcattcttattgtttttggtagtttgattgttgaaggcttttgacacgacattgaagtgaatatttggggcattttgctcctctgggcttttctctaaagcaccctcacatttcctctctcatgttcctgggctttcctggctttgatgctagccccactgtgtgttcccattaatagccctatgtagcctggctccttattctggaaactgtgtaacttttgctcttgatcttaaacacaactcagtcttgcaaggagctccgcctttggtctcagcttcttggggatttccctggcagccacatagtgaactatgtcacactctctgttttacccgttaataaggaaatactctggta

SEQ ID NO: 15086 - DNA, 360 bp, Homo sapiens
agtctatattggtctgcacaaataaactaaaatgctttttaagttgttttatgatctatatagaagagatattgacaaacttctcctgcttagaaaataaaagggacacttggaattaacaaagggggttggtagatttaccattgaggttgatgaacttaatatatcatctggtaaaacaagcgtcaggaaatatccatcattcaaatgttttggctgacagcaaaatgctcaaggactaatcccacagctgaaatgtaggggaaaatttcccctacatttggctccttctggctcctacttggtctacacttttggaaggactgctgagattgtatccttggagtcagggcgagagtg

SEQ ID NO: 15087 - DNA, 721 bp, Homo sapiens
gtatatacccagtaatgggatggctgggtcaaatggtatttttagttctagatccctgaggaatcaccacactgacttccacaatggttgaactagtttacagtcccaccgacagtgttaaagtgttcctatttctccacatcctctccagcacctgttgtttcctgactttttaatgatcgccattctaactggtgtgagatggtatctcattgtggttttgatttgcatttctctgatggccagtgatgatgagctttttttcatgtgtatgtttatattatgttatagatatacatcaagtataggtaactattcctattttaataagctttttgagatgtaattcacatactatgcaattcaccattttaaagtgtacaattcagtgccttaaaatattaatacattcacgaagttgtacaacaatcaccattaacttttgtatatgataagagttaggagtccaaattccttctttgcgtgtggtcatccagttctcccagcaacacttgtggaaaagattattctcccctattgaatggtcttggcacccttgttgaaaatcagttagttaatcccagcctgggcaacatagagagaccccatctccacaaaaaatcagccaggtgtggtggtgcctacctgtagtcctagctactcaggaggtcaaggctgtagtgagctgtgattgggagacagagcaaaagcctgtctaaaa

SEQ ID NO: 15088 - DNA, 334 bp, Homo sapiens
gagcaagtctctaatccacattaatattcaagaaaaaaaaattaaattcaaaagtacaactttacagcctgggcctgatggctcacatctgtaatcccagcactttgggaggccgaggtgggcagatcacctgaggtcaggagttcgaaaccagcccggccaacatggtgaaaccccatctctactaaaaatacaaaaattagttgggcatggtggcacacgtttgtagtcccagctacttgggaagctcaggcaggataaacttgaacccaggaggtagagttcgcagtgagtagagatcacactgctgcactccaaagtgagactccatctc

SEQ ID NO: 15089 - DNA, 291 bp, Homo sapiens
tagcagaaagccagccgcagcgagaccctccgcctggcatgcggcactggtgagccgccaccccgcttgctcagtaggtagccgggacgaaggggtctggcaggcccctcaggcaaggcctctgtgccgcatcccgttaaggggcggggaccagccccgtatcttggctggtcttcctgactctgaatgcagagaaagtatgtccaagagttcaaaccacatttgtgttcttttaatggtgtttaatgcagatgttaattgtgatttatgtgaaacgggttgatgtagagg

SEQ ID NO: 15090 - DNA, 462 bp, Homo sapiens
gagaggctggagggcatgaggactgataaactcgcctgccattgtctccaagggcgaccctgcaggaggtcaggctgcctgattatcgctcaggaatcctgctgtcggctattcctggctctgaccctcacctgctctctaacctcaggcagtcccctttgactgcccttatgctcaatttccccttttcgtcaatactcagatgccctctgcgacataaaccaggggccatttggcaaaatatcagtgactcccacccctgggagaaggctagtgttttgaacgattcattttaaagaacaaaatcctgttaattacttttcaacgtgaatataagcatacacacaatatacatattcgtatatattttcataggattctttcacatacacatatatttactactaataagtaaactataaacgttccttcaggagctagtaaaataaacaagacatatat

SEQ ID NO: 15091 - DNA, 209 bp, Homo sapiens
agttctggagattcatagtggtgataactacacaattactgtgaatgtatttaatgacattaagtacatttaaaattgacaacaaaagagtgaaactctgtctcaaaaaaaaaaaattaccactttaaaattttaaccactttaagtgtacaattaatgacactgaattgtacactttaagtagttaaaaatttaaagtagtaaatttt

SEQ ID NO: 15092 - DNA, 365 bp, Homo sapiens
aggcaacaatccatctttaaatataaaaagttagatatttattttagaatgatatagtaaattctaaattatagttttcatacaactaaaatatttagaataatttttgaaaagatttaaaatactattgtaaatctgtgaaatgacaaatcaaaagggcaaataaccttttagacttgagaaagagttttgactttgcagattttcaaaaaaggtattgggatacctaggggtttgtagaccatacctgaagaactgcttgatgaaatatagtattagaaacatggtctcagcttctcatgaaactctttccataggtggataaataatgatttcttttgatttacaaatttgtttactaagaa

SEQ ID NO: 15093 - DNA, 365 bp, Homo sapiens
gagtggccaaattctcatctgacacaatcaaatctctgtagaagtcttctatttgctgtcgtacaaagtgctgtgactttccaccttctttttttttttatttttcgagacagggtttcactcctgttgccaaggctggagtgcaatgatacgatctcagcttacggcgacctccgcctcctaggctcaagtgattctcatgccacagcctcccgagtagctgggaccacagacacacgccacggcaaacggctaatttttgtatttttagtagagacggggtttcaccttgttgctcaagctggtctcgaatttctgagcttgagtgatctgcccgccccagcctcccaaagtgctgggattac

SEQ ID NO: 15094 - DNA, 113 bp, Homo sapiens
catcttttaagtgttgggtaaagattgttttccatccacagtaaacacaggcatggggtctgatctgccctcttccactgttccaccctcaaggataaatacaataggtttca

SEQ ID NO: 15095 - DNA, 427 bp, Homo sapiens
ctagaggtgaaaggcaaggtcaaagactcttatcctcctgcgatcatcagcaggcagtaaccaagggagcgtggccaggcgctgaagtgaattcgggtccaaggagcctgctgggacccaggaaaacgagagaaggaacagaaattgtggtggaggcaaattcaagatcagaagattggggaggaggtgctaagagaggtctggagagatgctgggacccagaactggggcctcagtgagatcagcaggctgcagctaaactgtggtatccagaccatgcggccgatgccctgggagggagaccacttgcttaagtcctccaggagggcgatggaggagccggcattccaaccaggctcacggatgccaagatatggatgcagagagggaagccctgcagagcactgcctaccctgaagtgccagac

SEQ ID NO: 15096 - DNA, 1417 bp, Homo sapiens
caattatagattaaaaatatcagaagcatttccagattattcttaaaagttgatgagatcttcccaaaccagaatgacaactgaggatgagatgtgcatagattaaatggtaaagtgggtggttctcaggtgagaagcagtgaggaccattcattttgcagcctaaaaattttaggggatgcaaactgtcatttccccttcagttatgtaaataattgaagaaaataaggaaagcacataaactagcaaaaatctatagctcatgaacttggtttagtgtggacaaccctgttcttttcagaactatttaatcattaatagttcttaccaagtagaagtgatcccaggcaaagaaacaactttccaatgcattcaagagagaatcatacggacaaccatcattctcagcagctcattaaatgcaaatacacacacgcaaagagagagagagaacacattttacatagttttccagctgttgttagtgtcacttaaaactgatctctgctggtagtattcagttgtgagtatagcaagacactgcataggagcattttttttctaaacctttagctaagatttggaaacccaatatttcctaagtagtgaatgtggtctatttatagtaattagcttaggtgacacaccaaacatgatgagttgctcattcaggatagccggtccattgcacaaatgtgtaatatcaggtactctcatgccactcattgcctgcatcagtcagtcatgacctttgcatcagcctttcaatagacagtcatcaggctagtatcttatctcatcactacttgacgatgagttcgccgaattagactgttctataccagtacaacaaccaaaatactttctcatagattatgcataaatacgcaattttgtccatgtcaatgaacctaacaagaatgctttttaaaagtatattttagattcaaacatgctttctagatcagaggttaacttgtctttttgaaatcctggagtcacttataagttagctgcaaactgtagtttcggtaattcaactgcttaagcatttctggactgtttatcaaaatatattacagaatgtgagactaaagtttaaagtctggacctttggtttaatttctagactttccaaagcttttttttttctttttaaaaagcccattgtcaactctcttagaacttcatcaagtaaatggtaccttgcaaatgtaggttgtgtctgaccttctttctttttgtgtgttggtgcctcagatgtatcatgtgctgcttgaactgattctctacagtgttccttcctagtctcaagctgatgatgtgctcaaagatgtatcaaaatccatgtaatgacaccttttagatgtttctaatatgtcaataaatgatatattgcaatccttcagtagtattt

SEQ ID NO: 15097 - DNA, 254 bp, Homo sapiens
gtggtttaaaacaacggaaacctacttcctcactcttcgggggccagaggtccgaaatcgaggtgctgtcaggggtggctccatttggaggctgtgcagggaaccgtccccagcctcgcttcccatttccggtggggtctgcagttcctggtgccccttgacttgtgaatgcatcactccaatctatgcctccgtcttcacaaaccctccgtctctgcgttctctcctgttttcataaggcctgccctgaatgc

SEQ ID NO: 15098 - DNA, 462 bp, Homo sapiens
gaaaattgccttcctaagtaatttacctcaaatggtaggccttatattttaagagaataccatatttcaactatattttcacaccataatattaggcccctatatatcttatagcactttcacaattttcctctaggaagtagacatgaaataagattaagagactaagaataagatttaaaccagcctcccctttggaagcataaatgatgtgattgcagctctgggcctggagaatactgcagctttgtaaaatatatcaatggtactttcttgcttttacagtggcagaatatatatacaaaggacacctagtgcagtgggtagaacaaaaatgagctaagtgtctaacaaaacagatagagggctaacaaaacattacatttttttttatattccaggaactagtaattaaaataacaaaaatcttcttttcaatatgaagctattgatggtctctaa

SEQ ID NO: 15099 - DNA, 305 bp, Homo sapiens
taatggtccctcagtgcccaccgggtgatggtggcagattttccatccgcattgctcccggacatgcggatgtaggtttcagcagttcccatcattagacacagttgccgtaggctgggttcttagtagcaggctcagtggggcctttgagtctttccatggctggtgcccgccggactccacctgagggaaactaatggggaagcactggtctccattccctgcacgcacagcccactgctgcgatggtgaagggataaggttgtgttcacgcgtcgaagtttgtgtccactgcacacgcggct

SEQ ID NO: 15100 - DNA, 523 bp, Homo sapiens
cttttcctttaaaaaatatttttttcagaaagatgaaaaccacttcattagtgattgccggcaaaatctcctaatgtctttctataagctgtttaagcttagcattagaaattagtgctagaggatttaattagccagctcacaggatgcagtccctttaatttaggatttccctttgagaaaattatggagttgaaaaggaatatgatatttcatacaagtttccatcttgggcccttatgttgtttgttctgctgatctggaaattgtacatgatttacattaaaactttttgtttttaatatcgattattgtagtgtggggtgttagattatgtgcaatagttctcagagttgggaaaggtaaaagggtttttttgggcaatgattaactcatctactttaccagggttacataatcaagtattagttactatacatttagctaatgcagtgggtttagttaagcaatgaatacattatcatgggagcattaacacttttgcatttttagacttgccttt

SEQ ID NO: 15101 - DNA, 398 bp, Homo sapiens
cttaactgggataaattaattcagttacttttctgacaccatcatatctagtgaccagtgaagaattttccagatagcctactagtaaaataaagcacctagaaataagagtaagtgaactcgagaatgataagagctaaaggaatcccagaactgctatgcagtttcattattcccttaaattattggcatgccaagccctataattgctagatgggagaatatagataaactgaactttaagcagcccaatttatgacaatccagatttaccctaaagaaaaactaaagactaatggtttaatgtagaaatctttaaaaaataaagatttctgtacgtacatttaaactttcctggtttacaaaaggtaccaaaattaattcttttgtaatcggat

SEQ ID NO: 15102 - DNA, 413 bp, Homo sapiens
gaaggaataagggacttgatatttatctagcatcagcaatgtgtggacatcgtgtgaacggctttataaacatttcatttaattctctacatctagccattttttaacctgtgctttccctccctctcaaagtactgtttatacatttattagtccatattttaaacgctccatgctctcaactgtattaatgctatttgttaggataagtggcagatgtccatggaaaataagtggctgcaaagtggtaatgctgaccagatgagaaaagaagtgtaaaagggaagttctaaagaattaaagccctggagagggtgggtagacaacaacagtccaaaatagtgctcttcattgaggctgtgtagattttcctgcttcctgggaaaactggggcatatttacacttgcatgtg

SEQ ID NO: 15103 - DNA, 709 bp, Homo sapiens
ctgcaagccaaggagagaaatttcagaaggaaccaaccctaccgacatcttgatcttggactttaagctgccagaccttttatacattttctacagaaaatgcaccccatcattgcttatagcccacccacgtggactgctcattctgtgaatcatgttttacagatttgtttatgtggcattcctcgtttgaataaagcagaaccaaatgtcttggtttgaagattgagatgaaatgggagggccacaaatagtaatttatctttgagcatcgtatagataaacatgtaacctgatactaaacaaaagtaaatgctcatggactgtcagtgatgtggtgggatatgccagagggaagtgatttgtggactcactggagagagacttctactagaaaaattgccttgatgttaggaattaaaagaacaaaacaaaacaaaaaacatggagccgtatcctccagaagcttacatctgatttaacgagacaggtaagtacaatttcaacataatgcattaagtgctatgagagtagtatgatggtgataggtgctatacaagacaagggttctaggttaattgctttgagaaaattgccaccctttaacaaggttaaactggattctttaacgtcaaccttactgagagtttctaatatgtcactgtgctttgtgaatcttcatgtgtgtggagtagagatccagtctgcc

SEQ ID NO: 15104 - DNA, 373 bp, Homo sapiens
aaaggaaaggctagcttcaggccagaaggcgttgcaggatctaatatgtatgctaccatgggtgaccaagcataaagataaactaaggatttgaatatataagggctaatgtttgtgtccattgttatggaatttctgacaatcactctctagtctttcctaatatttggcctttaggaaaagtgttttggactgaattgttctctctcctcattatcctccttaatgtgtgaaagtctcaatgtaactgttgattacctgctctctatttcataaagaggaaaaacagatccagaggaccatttcatgattcatcctttttcaaaacgtttcttaaaacattaaataaagttttattattgtaaactgttta

SEQ ID NO: 15105 - DNA, 686 bp, Homo sapiens
ctgcaagccaaggagagaaatttcagaaggaaccaaccctaccgacatcttgatcttggactttaagctgccagaccttttatacattttctacagaaaatgcaccccatcattgcttatagcccacccacgtggactgctcattctgtgaatcatgttttacagatttgtttatgtggcattcctcgtttgaataaagcagaaccaaatgtcttggtttgaagattgagatgaaatgggagggccacaaatagtaatttatctttgagcatcgtatagataaacatgtaacctgatactaaacaaaagtaaatgctcatggactgtcagtgatgtggtgggatatgccagagggaagtgatttgtggactcactggagagagacttctactagaaaaattgccttgatgttaggaattaaaagaacaaaacaaaacaaaaaacatggagccgtatcctccagaagcttacatctgatttaacgagacaggaaaagtgttttggactgaattgttctctctcctcattatcctccttaatgtgtgaaagtctcaatgtaactgttgattacctgctctctatttcataaagaggaaaaacagatccagaggaccatttcatgattcatcctttttcaaaacgtttcttaaaacattaaataaagttttattattgtaaactgttta

SEQ ID NO: 15106 - DNA, 315 bp, Homo sapiens
aagcaaacttcacagtggggaaaccctgtgaagtcacccagctcatatgctctcatacccatcataacagccagcctgaaagtggctctaccccactggtgagatcctggcacagctgcccagccacctctggttcaatagctggcctagagatgtctcacctccctctccctacagagagagcaccacataaccactcaggcaccccacacacacccttggcctgacagcctgactggaggtggctcagaaagagccccatgcagccacacagcacaccacaccacaactcaacagccagtgcagcagtggctc

SEQ ID NO: 15107 - DNA, 466 bp, Homo sapiens
ctaaatctagctaattaacacaggtattatcgtttttgtggtaagaacacataactttaattctttagcattttttaagaatacaatctgttgttattaactatagtcaccatgttgtacgatagatgtttaacttattctttctatccaactgaaattttgtattctttgatcacccctctagtccctgttccccagccacccaagtccctggtaaccaccattctacgctctgctgcgatgagatcagattttttggatctgcatataagaagtgagatcatgcagcatttgttttttctgtgcctggcttattttgtttagcattacgtcctccagatttagctatattttgaagtggtagcttcacaaagatgtagaccatttgttagtctgggtcactgagtaagcaaccgtgccgacatacagtgttagacaggttcattctactgcaaatgacaggatt

SEQ ID NO: 15108 - DNA, 327 bp, Homo sapiens
gggagcttaaaactacaaaacttaatatggactctactaatttaagagttaaaattcaagtgtagttgcgtaaaatttattgcctgcattatctctgggggacacatatacttgaattaatcacataaaccaagatatatgtttggtccattaaaaatgaaagttgacaattttttcaaattccatttcaagagaaaatttacatagaaaagaatgaacttgaatgcatgtaattcttagatagacaaaataatctctgaactggtatgaaaaatacctgctactacctgccatgataatattagctttgtgatcttggacaaacca

SEQ ID NO: 15109 - DNA, 909 bp, Homo sapiens
tttttttagtagagacgggatttctccatgttggtcaggctggtctcgaactcccgaccacagttgatccgcctgcctgggcctctcaaagtcctggaattacaggcttgagccactgtacccggcaacattctgtcttaaaaaaaaaaaacacgggccgggctcagtggctcacgcctgtcatcccagcactttgggaggccgaggcaggcgaatcacgagacagatcacctgggcaagagagggagactccatctcaaaaaaagaaaaaaagaaaattaagtcccccccatgctcccgagtcttcttactcctcataggtgaccactgttcagtctaccgtttcttcccagaaatatgtgcacatacaagcatatacatatgtctactctttgcttagcaaaccatttattcagccaaattacaattgttgtctttgataaagcaggctacagacctccagatcctaaattggtggcaccaaaattagagaacttactttgtcttgaagagaacacttgcaaattgaccaggaacccctactgccagtgtacatgaattagacttccataaagattataacttaggtgccagaatacacattttgaaatgaatgtaggccatctaaaggcatttttagcttctaaacattaactttatgggggcataatttacagacaataaatatacctgcttacagtaaaaaaaacaaaaacaggacccacaaaaaaaaactttgtgggccggccctggcgccccggaagaaaggtctctctaagccccacccggttggggcgcggggcccccggattgggttacggggcacttgggccaagcgggtccaaaggagaccctgggccaagccctagcgcggggttccctcccaaaaaaaaacgcggggggccccgg

SEQ ID NO: 15110 - DNA, 1213 bp, Homo sapiens
cccagctgctgctgggagaagggacagactcagcttctgactgcaggggcatctgcaggaagatcggggaaactgaagacacttttaactgcaaaagccctagaaacagtaagtgcaaattgttccgtggattgttgacttcacattcaaaccatcgggaagtgatcgagactggaagcgtcgacaaggatccgcagggtctgggaccagagaccagcttgtgatcctgctgtggagtgctaggggtctgctctggggagggggctttggcctagaagagacatggtacagggtgggaactgttacagtcatgcaacacttaacatcaggtgattctgtcattgtacaaatatagaaagaactcacactaacccatacagcgtagcctctcaaagtcctggaattacaggcttgagccactgtacccggcaacattctgtcttaaaaaaaaaaaacacgggccgggctcagtggctcacgcctgtcatcccagcactttgggaggccgaggcaggcgaatcacgagacagatcacctgggcaagagagggagactccatctcaaaaaaagaaaaaaagaaaattaagtcccccccatgctcccgagtcttcttactcctcataggtgaccactgttcagtctaccgtttcttcccagaaatatgtgcacatacaagcatatacatatgtctactctttgcttagcaaaccatttattcagccaaattacaattgttgtctttgataaagcaggctacagacctccagatcctaaattggtggcaccaaaattagagaacttactttgtcttgaagagaacacttgcaaattgaccaggaacccctactgccagtgtacatgaattagacttccataaagattataacttaggtgccagaatacacattttgaaatgaatgtaggccatctaaaggcatttttagcttctaaacattaactttatgggggcataatttacagacaataaatatacctgcttacagtaaaaaaaacaaaaacaggacccacaaaaaaaaactttgtgggccggccctggcgccccggaagaaaggtctctctaagccccacccggttggggcgcggggcccccggattgggttacggggcacttgggccaagcgggtccaaaggagaccctgggccaagccctagcgcggggttccctcccaaaaaaaaacgcggggggccccgg

SEQ ID NO: 15111 - DNA, 429 bp, Homo sapiens
ggtctgtaaggaattgcaaatgagatggcacacatatttatgctgtatcaaggtcactgtcatcttaccatatcagactgaaaatgtcaccaccatctggacagtcagatatgttttatcgggaaaatggtttttctctttgtgtatatgctctgcagtagtagggtggtttagtaacaaatatgtgagaccttttatttgaaaaaaattgtttttaaataatgggaaaagcaatatgttagtagtaagtatctgggtaagtctatcttagcctttgttaacaaaaactaagaattgatggggccttgagattgaggtagagatgaaagaggagctgttaactacaatcttctacattatcagaaagagttgaagtgttaatttcactattagaaaaatgtaagataaagaatccttttggaaaatatc

SEQ ID NO: 15112 - DNA, 688 bp, Homo sapiens
tgggccatcccgggacagatttttaatagatcttttaatagtgataataaagtatgttactatgtcagcatcgacttttacttcaggttattgactaaattctgctagtgggaaaaatgagaagaaaaagtgtgctatccattattctgtgtggaaataaactggcagaactagtgacatcactaaaaaaaatggtgattttcaaattgtgttccaaaacctaggaagtggtagttctgaactttttttttaactagataactctttgaaaatctaatgaaaggtatgaacactctcctcagaagaaatgcacacatatgcatagagacgtagttttgtatacagttaaatgggcccccgggtattcctgaagccccaagtaaagaaccccttactgttaaccctttttgtatattctttgctatgcagtcatacctaagggatgtaataagtgtctgtttcatcagatccatacccttttccaacaccaatccagaaatgacatatttgtgggatgagcaccacattgaagactggcatagagagctcactgaaataatatcatccaggccaggcacgatgtctcaacgcctgtaatcccagtgctttgtggggctgaggctggaggatctcttgaggccaggagaccagcctgagcaacacagcaagaccctgtctctacaaaaaa

SEQ ID NO: 15113 - DNA, 405 bp, Homo sapiens
cacagggcttgccatgaagtggtttgttcatgatttgtttctgggaccctgggaaaaatgttctcagggtctgcctaggaaggctggttttggaagcttgtggatttctttctgggtgagtcaggaaagttgtgctcctgctgggcgcagtggctcatgcctgtaatcccagcactttgggaggctgaggcaggcggatcacaaggtcaggagatcgagaccatcctggctaacgtggtgaaaccccatctctactaaaaatacaaaaaattagccgagcgtggtggtgggcacctgtggtcccagctactcgggaggctgaggcaggagaatggtgtgaacccgggaggcggagtttgcagtgagccgagatcgtgccactgcactccagcctgggcgacagag

SEQ ID NO: 15114 - DNA, 1880 bp, Homo sapiens
acttgcctcccgtgccaggtgcttctggggctcagcaggagaggaaaggggcagaggggcatagggtccctcgggtacggtgggggcaggcgggcgcacagcgctccggctctgagccaggcctgtgagggaaggggctgcaggctggcagggtgccgacttcccccatggctgctgtgagcccgcagagtcatccttggccccgtcccgcccttggggaagaatgggcccctctgtcctcaggccccttcgacgtgctgagcatccagacgtggcgaggagcccgaagggtgtggggtcccctctgcagggtcctgcttgttgcctgtttccggcgggcggggtgcacaatggggtctctaaggaccgtttcccgccactggccccattgtcactgtctccgccttcctcctcggcctttcagccgcataaagggccagtgaggtttgggacagccacagcccaaggctccgaggctaaaagcccctgggtgggggtgttccaggacacctggccctgtgtgagctgcctcctctcaccccaacccctcggatcctgggaaagagacagccatggctcaagggccagggacccctgggctgagccccagaaatggctttccattctcgcctgggccggggtgggggtggaggccagagcctggcccaggcagatgaagcccccagctttcaagggggaaactgaggctgtgtgagggacacagctgtgcagggcccacaaacacggtcctttctctaggttagcggatgcagatgcctgatgagtgccatgccctctgtggacacctggggaggggggtcacctccagcgccgccctgggacttccactgcacgtgcaagagacttaccctttcacacagatcacctgcctgccgcagggctgatgaggatgggtgaggagcgcagccactgggtgtcatgcactgtgggggttctcccaccttctgcccctcctcaggttccttgctgcttctctcctctcccaactgtggcacgctgagggctcaggcacaggaccgctcctctggggcagcctccaataacccttggacaacctccactttttcatcttcagccctgaccactccctggggcccatagccttacatccatctgcccccagcccaaacacttctgcaaacactagaaaaggaggtagcccgtgtgccctcctgcaccgcctcctccactcctgtcttggagaggctttcccgtgggccgagcaacccccttacctttggcacttgccctgattctctggccagcttcctacaacctctccttttcagccacacccaagtccacctgttcacaaacaccctgggctgggccctggccgaaccctggcttctacctacctgtctcaggaagtgcctgagccttgcacctacagaccctcccagagaaagccctggctttgcaaccagctgtcttctcatgagacacagggccacaggagcaccacggtgcccaaatgggtcttggagcattagaccaggggcttcatgcctgccctggggacaggtggccaaagtggcatgggagatagggagacagtgtgggtgagcaggtgggcaggagctacaggagcctggggcctgtggatcacagacaccgccaggcaagtgccagttcacacaggtacaggtggctgcagagtgcccaaaggccaagcagcagagtgcctggtgtggacgggagaggagtggggaggttgggcgcagtggctcacgcctgtaatcccaacactttgggaggcccaggcaagcagatcatgaggtcaggagatggagaccatcctggccaacatggtgaaaccgtctctaataaaacacaaaaaattagccagacatggtggc

SEQ ID NO: 15115 - DNA, 560 bp, Homo sapiens
  misc_feature (67)..(67): n is a, c, g, or t
  misc_feature (282)..(282): n is a, c, g, or t
  misc_feature (534)..(534): n is a, c, g, or t
  misc_feature (537)..(537): n is a, c, g, or t
  misc_feature (544)..(544): n is a, c, g, or t
  misc_feature (556)..(558): n is a, c, g, or t
ttaacacccttatcttttttaatatgcaggtttggttgttttaactgaaagcatataacttaaatantgaaccaaaataacccaaactcttattcagcacatctcacagaatacacattttcaatattccagattagcaggatggagagttcaggagagagatcaaaatttaaatctgtcagtgacgaccacacacagcagcagactgcaaggttcttctcaataatgcaaaacatctttcatctatgaattttcccagttttcatgaatttaaatatctanagaaatgttataaaagctttaaaattcctaaatcccagtgctactctattccctattattccaggaccatttccaaaaccaaagctaccagaacagcttagaaatcattaggcggggttgaaaaatagactcttagatttaaatatacggttttggtggtttggttgtttctttagggttttttgttgtttttgttttgttttgttttttgttttggggttttgtttgtttgttgttttttgagacagagtntcnctctgtngcccaggctggnnntt

SEQ ID NO: 15116 - DNA, 434 bp, Homo sapiens
ccatatccattagcagccatttcccattaactctccttagccccttcttttttttttttgcaaccactaatttgctttctatctctatggatttgtctattctggatatttcagataaatggaatcatgtaacatgtggacttttgtaacttgcttttttcacttagtgtgtgtgtgtgtttctttttgagactgagtctttctctgtcgcccaggctggagagcagtggcgcgatctcagctcactgcaacctccctctcccaggctcaagcgattcttgtgtcttagcctcccaagtagctgggattacaggtgtgtgccaccacgccaggctaatttttgtatttttagtagagacgggttttcaccatgctggccacactggtcttgaactcctgaccacctcccaaagtgctcggattacaggcatgag

SEQ ID NO: 15117 - DNA, 589 bp, Homo sapiens
gtattgggggctcacagttagataaaggtctgaaacatatactattgggataccctgaaaagctagacttagtctacataaaaagattgaaaagattgaagatggatgtaaacaaggtgtgattttgtttttgaaacatggaaactgctgttatgtagctgccataataagcagagaaaagctgagtgttcggtctggtctgcactaagcctgcacagacatctcactcgagtctccacctgatggagggaaacttggaccacagagagggtgagtaactccctccagatcagacagctggccacagagccaggatttagggccagggctgaccccaaggtccatgtctttggaaaccaggctgtgaattcaggcccctcggcctattcttcagctctctgtcccaggacagataacttcatctcctcccagcccccacggaaaaaggaattctggataccagcgctaaaggataactcagcggaaagatttcaaaagctagattcattcaagggggtaggtaacttaacttcacttggttgtctgatgtttggaagatctaattagacctctgtatagcgtagggaca

SEQ ID NO: 15118 - DNA, 465 bp, Homo sapiens
gtgggcttcctaccagaaccatgagtaggtagggcagaatttcgatcctgagctgagagtggcacgtctggcctttgaacctggcccctaacctcacccagagactctgcactaaaacttgcagtccccgttctcccccaggggaggaagaatgggcctcttgcacgatgggatgttaggaacctctagtctattcatgaagctatttctctgctcttcattccactgttacagacttctttggtccctaaagattttatgcctccccagtcttcagctgaggcgcgaaacagattggatgacttttatcatggcctgattttcttttggcttgtcttggtttcatggaaacatatttcttttaaagtgaattctgggctgggtgccatggctcatgcctataatcccagcactttgggaggctgaggcaggaggatcacctgaggtcaggagatcaagtccagc

SEQ ID NO: 15119 - DNA, 397 bp, Homo sapiens
acattaaagacacaaaaagtatgtgtgctggagtcagaaatgttgggtcaggccttattttgactttgtgactagcagaagtcacttaacctttctgcattttggctccctcaactgaaaattaggggtgatgtgaataccttacaggtctgttataagcatcaagtgacatcatagctatgagagctctttgtagactgttggctcccttagctctctcagaggtctggggttaagtagaatatgacaaaacctagaacggttacatagggcagttagcatcatttatcactgataaatctttagaaagatatttcctgtcatttacatttctgcatcactaagtccaagatgatccttaatccatgatatacccggtaaaaattattgtttatta

SEQ ID NO: 15120 - DNA, 384 bp, Homo sapiens
tcattcactcaaattatctaattaaagcttcacagtgatcctcttaggttatttctcatcttacagatgtgcaaactgaggagaaggaagtgtaaggtcacgccgctggtagagttgggggccaaatccagatctgttggctctggaagctgtaaatcaaacacaaaaaggaaaaagtcaaaggcggtctggaaggcaagcctggaaggcacagaaaagagaagcgtcctcatactttgttcactctaaaccattgattcagggagagggaagcagtctgtggcaagtcggaagtgcgacgaggacgaagactgggtttgggttggggaacccctgtctgctgagccccttcactgcggtctcctctgcttgctccgcggagct

SEQ ID NO: 15121 - DNA, 2128 bp, Homo sapiens
gagctggtgctctcagccccctcatcatgggatgccttgcaccaccctggggccctgcagagtccctgccagcaagagggccctcaccagatgcaccccctagacttggacttcccagcctccagaaatgacttcatgtgcaagcgctttgccttaatgagtactgcagcaaatgcacagtgagggactcttacccaaggtgggaacagcaagcagtggattgaaagggctgggaccctggacccaggcttgttcttggatcacagaaacctagaatgaaatctgtgctgcctgctacaacctgtggctttggattttctcgaggccccagagcgtcagaggaagttttccgaatggcactctgcgtgggaaggagcttgtgcacgtgcacgctgccaccatctgccctcagcgctgattcaggaggcgcttctcaactatagcccacagtgtgacaactgaacgtgtcccctcacgtttccaaatacggggggtgcaggaggcactgctcactgttgcaccccctgacccacgctgccagtcctgccctcactgctgggtgctcactgggaccctggaaaggtctagctgagccttttagggcatgaggatgttgggagaatagaggtggctcctctgagaagcctgagaagtgatcaggccaaccttagaatctctgactactagaggcttgacttgcagtgaaacccgtcctaattgatgaagatcctgtatcgagttagagaaatggaagaaacgacgcgggggtctggtttgccagccaacagctgtggcttaaatctgagtcctttggaaagaaaggaaggcattccttttatttctaatatggctaaggtggaagttcttcatctctgtgtgcatgcagcttagttcctgctccttcagccaagctaacgcggaagccctagagcatctggaccaagcaaggaagccggcaggagcctctgcactgcctatgaatttgaccaacgggacttgggcctggaaaagagcatcccgaacagtggagaggaagagggagtgaggccctgtggacacagcagaggaatccacaatggatttgcagcaggctggtggaggcagagcagagaagggcgggagagggccagcgaaggcctgggaaggtggacccacaaactcgtctcctaatgaagctaaccagcaatgcgagggcacacagggagaccccctagaggctgccccaggccaggagtcacctgtgaactgaggtggccaaggcaggttctgtggcagagggtgaatgcctgcagatgagaaccagccgcggtgcccagaaaggaacagtgtgcgggcctgacgggagcccccatcaatacaaccagctcctgctcagaactctcttcaggcagacaaatagaagatatgtttctacttccccaggcctcagcaccatgactattctagtcccagtggataccctgcttcaggttttatgcagctgagttgaaaaagaataacagaataggaggaaaacaaggggaagaaggtaggtgggacgccccaaatcatcttgagtgcactccataaaagaaagaggcattaaagcagccccctctcctatctcaagccatccttcaacttatagggactttgcacatagttgctgcaggttggcctgcctctgtcagaggtgtttaaaccagattgactctctcttgtataggggctgggtaaaatgaggctgagacctactgggctgcattctcaggagattaggcattctaagtcacaggatgagataggaggtcggcacaagatacagatcacaaagaccttgctgataaaacaggttgcagtaaagaagccggccaaaacccaccaaaaccaagatggtgacgagagtgactctggtcgtcctcactgctacactcccatcagcgccatgacagtttacagatgccatagcaacgtctggaagttacctgtacggtctataaaggggaggcatgaataatccaccccttgtttagcatatcatcaagaaataaccataaaaatgggcaaccaggagcccttggggctcctctgcctatggagtggccattcttttattcctttactttctcaataaacttgctttcacttt

SEQ ID NO: 15122 - DNA, 1796 bp, Homo sapiens
tttgcagaacatggctttttagttataggattctccaaggtggtctcacaagtttctaatgaattgggttgggaagctactgctttagaaggcagaagcagtttcaagagtgtgctctgggtataaaagtcatgggtgcagaaggatatcagccccttcctaggtaattccatctctgctcactagtcctgagtctgagaaattgtcatcataaattaggcagacaggactgccagaagccaatccagaacatgaatttataacccagggctattgtatagcttcctgtgacctcttacacggagcctccctctgtcttcaggatcaggccaaccttagaatctctgactactagaggcttgacttgcagtgaaacccgtcctaattgatgaagatcctgtatcgagttagagaaatggaagaaacgacgcgggggtctggtttgccagccaacagctgtggcttaaatctgagtcctttggaaagaaaggaaggcattccttttatttctaatatggctaaggtggaagttcttcatctctgtgtgcatgcagcttagttcctgctccttcagccaagctaacgcggaagccctagagcatctggaccaagcaaggaagccggcaggagcctctgcactgcctatgaatttgaccaacgggacttgggcctggaaaagagcatcccgaacagtggagaggaagagggagtgaggccctgtggacacagcagaggaatccacaatggatttgcagcaggctggtggaggcagagcagagaagggcgggagagggccagcgaaggcctgggaaggtggacccacaaactcgtctcctaatgaagctaaccagcaatgcgagggcacacagggagaccccctagaggctgccccaggccaggagtcacctgtgaactgaggtggccaaggcaggttctgtggcagagggtgaatgcctgcagatgagaaccagccgcggtgcccagaaaggaacagtgtgcgggcctgacgggagcccccatcaatacaaccagctcctgctcagaactctcttcaggcagacaaatagaagatatgtttctacttccccaggcctcagcaccatgactattctagtcccagtggataccctgcttcaggttttatgcagctgagttgaaaaagaataacagaataggaggaaaacaaggggaagaaggtaggtgggacgccccaaatcatcttgagtgcactccataaaagaaagaggcattaaagcagccccctctcctatctcaagccatccttcaacttatagggactttgcacatagttgctgcaggttggcctgcctctgtcagaggtgtttaaaccagattgactctctcttgtataggggctgggtaaaatgaggctgagacctactgggctgcattctcaggagattaggcattctaagtcacaggatgagataggaggtcggcacaagatacagatcacaaagaccttgctgataaaacaggttgcagtaaagaagccggccaaaacccaccaaaaccaagatggtgacgagagtgactctggtcgtcctcactgctacactcccatcagcgccatgacagtttacagatgccatagcaacgtctggaagttacctgtacggtctataaaggggaggcatgaataatccaccccttgtttagcatatcatcaagaaataaccataaaaatgggcaaccaggagcccttggggctcctctgcctatggagtggccattcttttattcctttactttctcaataaacttgctttcacttt

SEQ ID NO: 15123 - DNA, 1191 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15124 - DNA, 1556 bp, Homo sapiens
cagacattaagtagctatttaatgagaagcaggcactggaagcttgctccagaaaaacaatcacaggacatgttggtcctgagagaagtcattccttggtaggacctattgtttgaaggaggtgggggtgaatttcatcaaaatggacagtgtggatattgtgattcagaggattgagagactttgtttcctgctgttattaatttcaagccctttttaaagggattctcctagtgattggtacagtgggattcatttagagaaaaagccttgtgtaccagttggaagttaatgcccaagagcagggccagttgctggaggacaaagtggcctaattagttgcttttcaatacttagatcctacaggctaccccaaagataaaataggctactttgtagctcagatcttccagcctagtgcctagcaagctcactaagaagaggaggtgacctgtagaatccacacctcttaatctccctatttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15125 - DNA, 1060 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggtccccaacctgccctgtccatccccctcccagactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15126 - DNA, 509 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtggtgagtacccagaccccatgcagagaggctctgctgactgctctcctggtggccagccactcccgccctcttctagtggcactggccagccctcctcctccgtccagctgggcaagagccagcggctgccgacccccaggctccctgtggactcagtctcctcccaaagccacttccacccctcaagggtggccatgggtgccgctcaggcgtggtgtcccctgtaccccggaagcagacgtctgctgactttcgctttgcagatgaggacctgggagtgagagctcctgggactcgctgaggccagggcaggggctgggatgatggcgcgggagaggctgtgtcctc

SEQ ID NO: 15127 - DNA, 1469 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtgcttctgaagccccactgggtgttactgcagcagggcgtggcccaggccgagggatggtgccagcagggtggaggccaagtcccaggctttcaggtgtgtgtgtcccaccacactggccgtggtaaacatctgcccatcctcccagctcctgtgtcagagcctgggggacgagtcacccagctcacccccacatgctcaaaacagtcaccaagtcctctgggctccgtccccttaaaaaataccccaatagctaaaataatacattcatagaaaacaac

SEQ ID NO: 15128 - DNA, 1223 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggtccccaacctgccctgtccatccccctcccagactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15129 - DNA, 1475 bp, Homo sapiens
cagacattaagtagctatttaatgagaagcaggcactggaagcttgctccagaaaaacaatcacaggacatgttggtcctgagagaagtcattccttggtaggacctattgtttgaaggaggtgggggtgaatttcatcaaaatggacagtgtggatattgtgattcagaggattgagagactttgtttcctgctgttattaatttcaagccctttttaaagggattctcctagtgattggtacagtgggattcatttagagaaaaagccttgtgtaccagttggaagttaatgcccaagagcagggccagttgctggaggacaaagtggcctaattagttgcttttcaatacttagatcctacaggctaccccaaagataaaataggctactttgtagctcagatcttccagcctagtgcctagcaagctcactaagaagaggaggtgacctgtagaatccacacctcttaatctccctatttgccacctgagcgccgctccctctcaggatgaaggtgacggtgggcccagacccttccctggtctaccgacctgatgtggacccagaggtggccaaagacaaggccagcttccggaactacacgcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15130 - DNA, 1511 bp, Homo sapiens
cagacattaagtagctatttaatgagaagcaggcactggaagcttgctccagaaaaacaatcacaggacatgttggtcctgagagaagtcattccttggtaggacctattgtttgaaggaggtgggggtgaatttcatcaaaatggacagtgtggatattgtgattcagaggattgagagactttgtttcctgctgttattaatttcaagccctttttaaagggattctcctagtgattggtacagtgggattcatttagagaaaaagccttgtgtaccagttggaagttaatgcccaagagcagggccagttgctggaggacaaagtggcctaattagttgcttttcaatacttagatcctacaggctaccccaaagataaaataggctactttgtagctcagatcttccagcctagtgcctagcaagctcactaagaagaggaggtgacctgtagaatccacacctcttaatctccctatttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15131 - DNA, 1276 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggtaggtggggggaggggcaacgcagcccgtccaccaggcccggtcctgcagccccaagtgagccgctgggtggccttgcccgcaggctttctacatgatccggttccactccttctacccctggcacacgggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15132 - DNA, 1296 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggctttctacatgatccggttccactccttctacccctggcacacgggccgcgactaccagcagctgtgcagccagcaggacctggccatgctgccctgggtgcgggagttcaaaagtacgccccgctacccgccgaggggtgttgtgggagtgaaaaagggggttgggtggggggcctgggggttcttcacggggctcaccgcccctccctgctgcagcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15133 - DNA, 1381 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggtaggtggggggaggggcaacgcagcccgtccaccaggcccggtcctgcagccccaagtgagccgctgggtggccttgcccgcaggctttctacatgatccggttccactccttctacccctggcacacgggccgcgactaccagcagctgtgcagccagcaggacctggccatgctgccctgggtgcgggagttcaaaagtacgccccgctacccgccgaggggtgttgtgggagtgaaaaagggggttgggtggggggcctgggggttcttcacggggctcaccgcccctccctgctgcagcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15134 - DNA, 1145 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaagttctcactgccccctgaggccgcgactaccagcagctgtgcagccagcaggacctggccatgctgccctgggtgcgggagttcaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15135 - DNA, 1059 bp, Homo sapiens
acacattaactccctgaggccgggaggagggtggatggtcatttattactgcggacacttatgtaacctggggtgtatataggagcctggctgaggacacactcgccagcctgtgctttgccacctgagcgccgctccctctcaggatgaaggtgacggtgggcccagacccttccctggtctaccgacctgatgtggacccagaggtggccaaagacaaggccagcttccggaactacacgtcaggtcccctcctggaccgtgtcttcaccacctacaagctcatgcacacgcaccagacagtggacttcgtcaggagcaagcatgcccagtttgggggcttctcctacaagaaaatgacagtcatggaggccgtggacctgctggatgggctggtggatgagtcggacccggacgtagatttccccaactccttccatgccttccagacagcggagggcatccggaaggcccacccagacaaggactggttccacctcgtcgggctcctgcacgacctggggaaggtcctggccctgttcggggagccccagtgggctgtcgtcggcgacaccttccccgtcggatgccgtccgcaggcctccgtggttttctgcgactccaccttccaggacaaccctgacctccaggatcctcgatacagcacagagctcgggatgtatcagccccactgtgggctcgacagggtcctcatgtcctggggccatgatgagtacatgtaccaggtgatgaagtttaacaacaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgtg

SEQ ID NO: 15136 - DNA, 481 bp, Homo sapiens
caccctggtatctcactgcagcacagagctcgggatgtatcagccccactgtgggctcgacagggtcctcatgtcctggggccatgatggtgaggccagaggcgggcagtggggcggtggggggcggtgggggacggtggggggcggtggggcagaggcagtgcctgctggtgacaccctctccccacagagtacatgtaccaggtgatgaagtttaacaagttctcactgccccctgaggtaggtggggggaggggcaacgcagcccgtccaccaggcccggtcctgcagccccaagtgagccgctgggtggccttgcccgcaggctttctacatgatccggttccactccttctacccctggcacacgggccgcgactaccagcagctgtgcagccagcaggacctggccatgctgccctgggtgcgggagttcaaaagtacgccccgctacccgccgaggggtgttgtgggagtgaaa

SEQ ID NO: 15137 - DNA, 515 bp, Homo sapiens
aggctttctacatgatccggttccactccttctacccctggcacacgggccgcgactaccagcagctgtgcagccagcaggacctggccatgctgccctgggtgcgggagttcaaaagtacgccccgctacccgccgaggggtgttgtgggagtgaaaaagggggttgggtggggggcctgggggttcttcacggggctcaccgcccctccctgctgcagcaagttcgacctctacaccaagtgcccggacctgccggacgtggacaagctgcggccctactaccaggggctcattgacaagtactgccctggcatcctgagctggtgaccctcctgccacccaagctgctgctggacctaggcctggccctccgcctgcctggagaggcctggccctgggcaaacagccgccatcagggttcacctcggtgggggaccccactcacccccttagggtcgccacccctcacggcaacttgtgcctggcgtcaataaagacctggaaggatgttgt

SEQ ID NO: 15138 - DNA, 330 bp, Homo sapiens
ctctggtgactggtctcaccaagtcaccacctccaacccccaggcctggccaggcccccttcctctcttgcgtgggcaggtgccccaatgcttagcccttgctcagtggcagtagtcactcggggggcgtggggggggtggggggtgaccttgagtgaccttcccatggagcccagatgtccctggggccataaaaagtgcttattaaacaaatgaagaggccagctcatgctggtaatcccagaactttgggaggcggaggcaggaggatggcttgaaagccagaaattcaagactacccatagcaaccttgcaagaccccgtttctat

SEQ ID NO: 15139 - DNA, 261 bp, Homo sapiens
ccaatgtataaggacttccatattggttttccaaaaaccaaaggtagctttgaaaaccacgtctgaggccggatgcagtgctcatgcctgtaatcccagccctttgggaggccaaggcgggtggatcacgaggtcaggagttcaagaccagcctggccaacatgatgaaaccctatctgtactaaaaataccaaaattagccaggtgtgatggcacatgcctgtaatctcagctactaaggaggctgaggcaggagaatca

SEQ ID NO: 15140 - DNA, 525 bp, Homo sapiens
tgccacccaagctggagtgcagtagttgatcacagctcactgcaaacattgatctcctaggcctcaagcaatcctcccacctcagcctcctgagtagctggggctacaagtgcatgctaccatgcccagctaactaaaaaaaaaaaatcatggagacgaggtctcactatattgcccaggctggtcttgaactcctgggctcaagcaatcctcccatctcagcctctcaaagtactgggattaaaggcgtcagccatcatgcttggcagcgctattttcaaggtgcagtgttcttaaagacaagaaaaggaccccaaagacaattcaatcatcaaggctgccactcccaccacaggcccagagtgcacaggccggaaccaggttgccgccacctccgttttttttgttgttgttgctttttttctgagacggagttttgctcttgccacccaggctggctggagtgcaatggcgcaatctcggttcactacaacctgggcaacagaagtgagactccgtctcaaa

SEQ ID NO: 15141 - DNA, 416 bp, Homo sapiens
ataatgcatgtaaagcactcaacatagtacctgactcatgataagtgctcagtaaatactatttttctttagagattttgctaatttcttttaaaaagagtccttcttaccctggctagcagttgggagattggtgcttgggagagattaaaagggctcagattggccaagctcagtgtctcatggctgtaatcccagcactttgggagttcaagatcagcctgggtaacatagcaaaaccccatctctacaaaaaatacaaaaattagctgggtgtggtagtccatacctgtagtctcagctactcgtgagactgaggtgggagaatcacctgagcctgggaggctgaggctgcagtgaggtgtgattgtgccattgtactccagcctgggcaaataggagtgagaccatgcctg

SEQ ID NO: 15142 - DNA, 496 bp, Homo sapiens
gtgacttgttcttgggaactttgtatttaagaagtgtcatttcttcactttagtatctcagttggaaccaaccgcaaatcctgaatgcaatcaataaagtccaaaataggcccctgcactaaggtttgatttatttatcggaaagttgttcctaatttgttggcgtttcttttttttttttgagacaaggtccctgtctgtcacccaggttggagtgcagtggcaccatcttggctcactgcagcctcgaccacctgggcttaagcaatactcccacctttaccctcccaagtagctgggattgcaggcacatgccaccctgcctgtaccagtttttgtatttttttgtagagatgatttcaccatgttgtccagactggtcttgaactcctgggctcaagtgatcctcctggcttgccctcccaaagtgctggcattatgggcgtgacaaccgtacccagccaacattctttttttttttttttttgaggcggag

SEQ ID NO: 15143 - DNA, 720 bp, Homo sapiens
ccaggctggagttcaatagcgggatctcagctcactgcaacctccgcctcccaggttcaagcgattcttctgcttcagcctccctagtaactgggattacaggtgcctatcaccatgcccggttaatttttgtatttttagtagagatggggtttcaccgtgttggccaggctggtctcccaactcctgacctcaggtatctgcctgccccagcctcccaggattacacatgtgagccaccgtgcctggccaacattcatttttcaattttttataaagctttagtagattcttagaagccagcaatctagtatgctgatagcaataaaaactaagaagcattttcagacttccatgcgttgctgatgtagtttcttcttcctcccttcccatctggctggtatctttattctgtctgaaaggtatgcctcaaatatctttaccttttgtctattcccacaccattcctcactctcctcttacaaccgcccaccccccaaattaattcttctgtggtctgtgattttacagtgtcgtgttcataactcccaaaacattgatcacaaaatactaaaatacaaaaaaattagctgagcactgtggcatgcacctgtaatcccagctacttgggaggctgaagcaggacaattgcttgaacccgggaggctaaagttgcagtaagctgagatcaggccactgcactgactctgtctcaaaaag

SEQ ID NO: 15144 - DNA, 490 bp, Homo sapiens
gctagaggaaaaataatactataactgacatcattgggtcaatgacgaaatcagactattagataactgtgaatgttaatgttaaattgtctgaagttgataattctactatggttatgtaagagaatgtgagagactacccctgaagtatttaggggtaaagggggataatgaactatatgtaacttaagctcaaatggttcagcagtgagcctggtgtctgggcgcgtgcaagccctcttcatctgtctgtccctggcagtgctgcgccgttaattatgttatggctggggattggattgaattggaattgcactgctgtgactctgtagagaacaggagagaatataggattctctgttttcaaggcctggaaacaattagaatattgatcacctctaaccgctttttaaacagttaaaagttaaaagctccctttgggagtttgcctgtgtaaacttatgtgaagccaggcagctgaccagagcct

SEQ ID NO: 15145 - DNA, 580 bp, Homo sapiens
ccaaagaagtaaaataattgggtcaatataaaaagaaagtagaatattgcccagagaggagatgtggataattcctaacacggatcaaaggtgagctgtgtctaagacagtcagacctgcaccgtcccgtgcagtagacaccgtggccgctgtgtctgagatattcagaccctcgccgtcccgtgcagtagacacggtggccgctgtctgtaagatattcagaccctcgccgtcccgtgcagtagacacggtggccgctgtgtctaaaatattcagtcccgtgcagtagacacggtggccgctgtgtctaagatattcagacctgcaccatcctgagcagtagccacagtggcaagtagcctctgcactggacagtgcagctacagaatgatgctatcactagaaagttccatcagccagcactgatgcagacctttgcaaatgcccctcacactgaatagcacctagctgatagattgtccactactcagtgaaaagcctgtgttaaaagcagtatttggtagaaaagcaaaaaaggggaaaaaattaaaagtggtaagtcattgtcttccttactgaa

SEQ ID NO: 15146 - DNA, 367 bp, Homo sapiens
aggttacagtgagccgagatcatgccactgtactcccgcctgggcaacagagcaagaccctttaaaaaaaatatatatgtgaataagtggacccatgcagtccaaaaacgttattgtttaagggtcaacaataatgacctgatgtattttctactttttagaacaacagatgcttattaaattaataatatgtttattaaagcattatttcataatctgcctttctagaagtttggtgatgtccaagttcagctttaggcaacttaatttgctctcttttctctctgccttcctgggttaaagaaaaggataactgtagttaggctattaaaaataaagtatgtgaatgtaaaagagcttctaccaa

SEQ ID NO: 15147 - DNA, 364 bp, Homo sapiens
agaactgaaatctggcagatgaccctctagggaaatgaaaaacatgttgtctagctgacgttggtttttaaatttagatcaaataacattgtctttgaagtctcaagagtcctacttaaggtagctgtatcagataggctcgcctttgagagcatttcttgcaggccggcacccctaatatgaaaagttaagcctagtcaaaaataagtgaaaaagaaagttttattggagttattttctctaagatagctgtttcagaagaaccttgacgagtcatctccttgtctctagacaggaacacacaaggcatatgggtatctgtagtattttaaaagaccttaggggaccaggcttcttccataac

SEQ ID NO: 15148 - DNA, 414 bp, Homo sapiens
cgccctgcgacccccgccccactaccagcccgagctgggtccgccctctgagacagtagggccggtgaccgagctgctcgcgccaattcctactgctaggttcccacaagatcccaccctatcctgtgactgcttcacctgcaaggagttcttgaacttctggacttgactgagcgatggcatcttcaccctgtcatccactgaggcatctgaggccctgacggatccccaagggaaagtttcctggaggagccgcgacccggggatgcgcccccaaccttttgccctccggacaagagcacttcctgaagtgcagacgtactcactccccaggagatgtttaggaaactgaacattccaaccagacaagcaaaaaattaaaatcttaattctttgaaaatacagacttgcaaa

SEQ ID NO: 15149 - DNA, 372 bp, Homo sapiens
tactagacctctgaaatgcagacctaagaaatgcctggtgatggcactaaagctgacgtcactatgaaaagcaggcaggaggtattgtaccccttgtgaggaagtttaaaagtttcttatagcaactaacttctccattaacaaataaatagaccttccatagcagctagaaggtacctcatcccctttattgaactgtggccatggacttctcaatgatatccctgtaaccctaagacctagtgaaaaacctggtacaggaaaaagtatacagtaaatattagatgaagaataggcaggagaatcacttgaacccggggggtgaggtgcggaggttgcagtgagccaagatggtgccactgcactccagcc

SEQ ID NO: 15150 - DNA, 274 bp, Homo sapiens
aaaacttttttgctttttggaagagtagggaatcgaaatagtacaggactgtacagttttgaaaaacaaatcctttctagtcctcaaaaacctggcttccctttatccatttcttaccacagaaacagcagaacttgatactattctgcctacttttagaactgaatgtttaaggttttttcaaatttttctgagtttaaagagcctagcagcaggaaaaaaaaatggtagcgtgagaactgtgggaagggtctgttttgttttatttcaaaca

SEQ ID NO: 15151 - DNA, 1840 bp, Homo sapiens
ggcctagccggtggttcaggtggccggtcgggctggaagggcggggatgagggatgggacgcatccccgggggatgctcctccaaagcttttatcgggcgagcgcagtggctcacgcctgtaattcctgcactttgggaggctaagggtctcactctattgtctaggctcgaatgcagtgacgtgatcatggatcactgcagtcctcaacttactgggctcaggatgaaaggcttcctagcacaaacaccacccctggagttcccggtacatcaataccagcctggggatcacgttctcatcaagagttggaagagggaaagcttgaaccagcttaggaggacctcatctggtactcttgatgaatgaaacagcaatctgaatggctgaaaaaggatggacccagcactccagggagaaaacttggcattctttgggaatctaacaggatgcagtgaacccaagccttttgaagagctcaccaatcagactgcccttgtctatccatgagcagatgtttgatagtattgcggaggccctctagtgggtatgctgccaagcaactggagtggcacttgggctctaatccagttgtctatccctttcaccctggcatttcatcagccaaacaaaaaccaactaactcagaaaaaaaggaaagcccctcaagggtcctttgaccccgatatctacatagatgctatcggggtcccctgaggggtaccaaacgaattcaaagctcgaaatcaaatagctgctggattcaagtctgtccttttcttgtggtctactataaataaaaatgtagactggataaattacatatactataaccaacaacgatttgtcagttacaccagggatgccattaaaggaatagctgaacaattgggtttcaccagccaaatggcctgggaaaatagaatagctcttgacatgatattagtggaagtccaatgttgtacctgtatccccaataatacagcccctgatgtaactatcactaagggtctataaggcctcaccactctaggaaatgaactagctgaaaattcgggaatgaatgatccctttacaggtgtaatggaaaaaatggtttggtagatggaaaggactaatggcctctattctcacctcccttgtgatcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagccaccttctgcagaagtaaaccttgccttgctgagaaatttttcttttgagtgctggtctctctctgtggcaccaagaacttatttctaacatggagtgatttccaagatagatggttaagtgaaaataaaaactgttgccaggcacggtagctcatgcctgtaatccc

SEQ ID NO: 15152 - DNA, 1524 bp, Homo sapiens
ggcctagccggtggttcaggtggccggtcgggctggaagggcggggatgagggatgggacgcatccccgggggatgctcctccaaagcttttatcgggcgagcgcagtggctcacgcctgtaattcctgcactttgggaggctaagggtctcactctattgtctaggctcgaatgcagtgacgtgatcatggatcactgcagtcctcaacttactgggctcaggatgaaaggcttcctagcacaaacaccacccctggagttcccggtacatcaataccagcctggggatcacgttctcatcaagagttggaagagggaaagcttgaaccagcttaggaggacctcatctggtactcttgatgaatgaaacagcaatctgaatggctgaaaaaggatggacccagcactccagagtctcacactgtcaccaggctggagtgccgtggcgcaatatcagctcactgtaacctccacctcccaggttgaagtgattctcccatctcagcccccaagtagctgggactacaggtgagtgccaccacacccagctaatttttgtatttttagtagagatgggggttcaccatgttgcccaaaatggtctcaatctcttggcctcgtgatccaaccatctcagcctcccaaagtgctgggtttaaaggcatgagccactgtgcctggcccagaattctttactgctaacacgagtgggcctggttctggaggatttcccagtgggtcctgaagaaccacagtttattggcttgtgggcaaagggggtatgtgtatcagttggcctttactgtgtaataaacagccacaaaaattactagctgaaaacagcagctacttaattagcagaagcctcttgaggatggacttgcaaaccaaagttgtgctggtttctactggtcaaagcaaggactggctcacataaaaaggagagagattgcaccttcagagagtaatctcaagacatctgtaatctaccacagggtgtcactgggcctctgtcaaggagcctattctttctgccaccagatctgtctaatagcttgtgtgacaatgcacttccttctgggtctctctccaagtgtagtaagtgtatatgggaatcactttattcaaacagtgtagtgcacttagttagaaagaaaaggtattaaggaagacttatatttaaaattgttatttatggtaacaacgaaaagtaacatacaaatttcaaacatcaagaataaaataaattaaaggtatgatcaatacacatcagtacaaagaggggaacacaatgaaacaaacaaaaaaaattagatgctagaaattaatccaaattattactaattaaatgtcaggcactaaatgtgcaacataaaaggattgttaattggtattattcaagtattttttcttttttttttttttttgtgacagagtttcactcttgttgcccaggctgcagtgcaatggcgtgatctcggctcactgcaacctctgcctcccgggttcaaatgattctcctg

SEQ ID NO: 15153 - DNA, 1763 bp, Homo sapiens
ggcctagccggtggttcaggtggccggtcgggctggaagggcggggatgagggatgggacgcatccccgggggatgctcctccaaagcttttatcgggcgagcgcagtggctcacgcctgtaattcctgcactttgggaggctaaggatgaaaggcttcctagcacaaacaccacccctggagttcccggtacatcaataccagcctggggatcacgttctcatcaagagttggaagagggaaagcttgaaccagcttaggaggacctcatctggtactcttgatgaatgaaacagcaatctgaatggctgaaaaaggatggacccagcactccagggagaaaacttggcattctttgggaatctaacaggatgcagtgaacccaagccttttgaagagctcaccaatcagactgcccttgtctatccatgagcagatgtttgatagtattgcggaggccctctagtgggtatgctgccaagcaactggagtggcacttgggctctaatccagttgtctatccctttcaccctggcatttcatcagccaaacaaaaaccaactaactcagaaaaaaaggaaagcccctcaagggtcctttgaccccgatatctacatagatgctatcggggtcccctgaggggtaccaaacgaattcaaagctcgaaatcaaatagctgctggattcaagtctgtccttttcttgtggtctactataaataaaaatgtagactggataaattacatatactataaccaacaacgatttgtcagttacaccagggatgccattaaaggaatagctgaacaattgggtttcaccagccaaatggcctgggaaaatagaatagctcttgacatgatattagtggaagtccaatgttgtacctgtatccccaataatacagcccctgatgtaactatcactaagggtctataaggcctcaccactctaggaaatgaactagctgaaaattcgggaatgaatgatccctttacaggtgtaatggaaaaaatggtttggtagatggaaaggactaatggcctctattctcacctcccttgtgatcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagccaccttctgcagaagtaaaccttgccttgctgagaaatttttcttttgagtgctggtctctctctgtggcaccaagaacttatttctaacatggagtgatttccaagatagatggttaagtgaaaataaaaactgttgccaggcacggtagctcatgcctgtaatccc

SEQ ID NO: 15154 - DNA, 1701 bp, Homo sapiens
ggcctagccggtggttcaggtggccggtcgggctggaagggcggggatgagggatgggacgcatccccgggggatgctcctccaaagcttttatcgggcgagcgcagtggctcacgcctgtaattcctgcactttgggaggctaaggggatcacgttctcatcaagagttggaagagggaaagcttgaaccagcttaggaggacctcatctggtactcttgatgaatgaaacagcaatctgaatggctgaaaaaggatggacccagcactccagggagaaaacttggcattctttgggaatctaacaggatgcagtgaacccaagccttttgaagagctcaccaatcagactgcccttgtctatccatgagcagatgtttgatagtattgcggaggccctctagtgggtatgctgccaagcaactggagtggcacttgggctctaatccagttgtctatccctttcaccctggcatttcatcagccaaacaaaaaccaactaactcagaaaaaaaggaaagcccctcaagggtcctttgaccccgatatctacatagatgctatcggggtcccctgaggggtaccaaacgaattcaaagctcgaaatcaaatagctgctggattcaagtctgtccttttcttgtggtctactataaataaaaatgtagactggataaattacatatactataaccaacaacgatttgtcagttacaccagggatgccattaaaggaatagctgaacaattgggtttcaccagccaaatggcctgggaaaatagaatagctcttgacatgatattagtggaagtccaatgttgtacctgtatccccaataatacagcccctgatgtaactatcactaagggtctataaggcctcaccactctaggaaatgaactagctgaaaattcgggaatgaatgatccctttacaggtgtaatggaaaaaatggtttggtagatggaaaggactaatggcctctattctcacctcccttgtgatcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagccaccttctgcagaagtaaaccttgccttgctgagaaatttttcttttgagtgctggtctctctctgtggcaccaagaacttatttctaacatggagtgatttccaagatagatggttaagtgaaaataaaaactgttgccaggcacggtagctcatgcctgtaatccc

SEQ ID NO: 15155 - DNA, 1803 bp, Homo sapiens
ggcctagccggtggttcaggtggccggtcgggctggaagggcggggatgagggatgggacgcatccccgggggatgctcctccaaagcttttatcgggcgagcgcagtggctcacgcctgtaattcctgcactttgggaggctaagggtctcactctattgtctaggctcgaatgcagtgacgtgatcatggatcactgcagtcctcaacttactgggctcaggatgaaaggcttcctagcacaaacaccacccctggagttcccggtacatcaataccagcctggggatcacgttctcatcaagagttggaagagggaaagcttgaaccagcttaggaggacctcatctggtactcttgatgaatgaaacagcaatctgaatggctgaaaaaggatggacccagcactccagggagaaaacttggcattctttgggaatctaacaggatgcagtgaacccaagccttttgaagagctcaccaatcagactgcccttgtctatccatgagcagatgtttgatagtattgcggaggccctctagtgggtatgctgccaagcaactggagtggcacttgggctctaatccagttgtctatccctttcaccctggcatttcatcagccaaacaaaaaccaactaactcagaaaaaaaggaaagcccctcaagggtcccctgaggggtaccaaacgaattcaaagctcgaaatcaaatagctgctggattcaagtctgtccttttcttgtggtctactataaataaaaatgtagactggataaattacatatactataaccaacaacgatttgtcagttacaccagggatgccattaaaggaatagctgaacaattgggtttcaccagccaaatggcctgggaaaatagaatagctcttgacatgatattagtggaagtccaatgttgtacctgtatccccaataatacagcccctgatgtaactatcactaagggtctataaggcctcaccactctaggaaatgaactagctgaaaattcgggaatgaatgatccctttacaggtgtaatggaaaaaatggtttggtagatggaaaggactaatggcctctattctcacctcccttgtgatcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagccaccttctgcagaagtaaaccttgccttgctgagaaatttttcttttgagtgctggtctctctctgtggcaccaagaacttatttctaacatggagtgatttccaagatagatggttaagtgaaaataaaaactgttgccaggcacggtagctcatgcctgtaatccc

SEQ ID NO: 15156 - DNA, 936 bp, Homo sapiens
tgcttggccctttattcttttacatatttaattttttaaaaaatcaacaaagatagagggaaaacccaaaatggaatacgaacaggaacaatcaatctgaactttgtatcaaatgggtaataagactatgtaacaggaacaacacaacaacagttgctgcctagacattagaaatagaggccaggcacaggggtatgtgtatcagttggcctttactgtgtaataaacagccacaaaaattactagctgaaaacagcagctacttaattagcagaagcctcttgaggatggacttgcaaaccaaagttgtgctggtttctactggtcaaagcaaggactggctcacataaaaaggagagagattgcaccttcagagagtaatctcaagacatctgtaatctaccacagggtgtcactgggcctctgtcaaggagcctattctttctgccaccagatctgtctaatagcttgtgtgacaatgcacttccttctgggtctctctccaagtgtagtaagtgtatatgggaatcactttattcaaacagtgtagtgcacttagttagaaagaaaaggtattaaggaagacttatatttaaaattgttatttatggtaacaacgaaaagtaacatacaaatttcaaacatcaagaataaaataaattaaaggtatgatcaatacacatcagtacaaagaggggaacacaatgaaacaaacaaaaaaaattagatgctagaaattaatccaaattattactaattaaatgtcaggcactaaatgtgcaacataaaaggattgttaattggtattattcaagtattttttcttttttttttttttttgtgacagagtttcactcttgttgcccaggctgcagtgcaatggcgtgatctcggctcactgcaacctctgcctcccgggttcaaatgattctcctg

SEQ ID NO: 15157 - DNA, 447 bp, Homo sapiens
ggcctagccggtggttcaggtggccggtcgggctggaagggcggggatgagggatgggacgcatccccgggggatgctcctccaaagcttttatcgggcgagcgcagtggctcacgcctgtaattcctgcactttgggaggctaagggtctcactctattgtctaggctcgaatgcagtgacgtgatcatggatcactgcagtcctcaacttactgggctcaggtaatcctcccacctcaacctcccaggtagcagagattacaggtgcatgccaccaccatccttggctgaattaaaaaaaatttttttgtaaagaccatatttcaccatatgcccaggctggtcctgaagtcctaatctcaaggaatcccctggcctcagcctcccgaagtgctgggattacaggctggagtgcagtggcacaatctcagctcactgcaaactct

SEQ ID NO: 15158 - DNA, 418 bp, Homo sapiens
agtagactgtgttgatctgttagcgagtttattgtttcaaaggaggaaaacatattgaggtcagttacagaaatggaatatttgaagtcgatgaattcaaggaaatatattcaggtcaccaataccttgtgcagaaatagataaaaagaagagggtaaaagtgcaaattatttacattcttgaaaccacaaaagtgaactgagccaagaacacagctggaatgtgacccagtggggtagggagtcccacagagcctgaacacaagcccacttaggcttccttggttaagacctgaacttccccatctgataatgggaaaaaacacatccaaaggaagtaaatagtaattacatgtggagctagtggttgtctttctagttccaccttgggattgaggttacaaaagataacgtagaga

SEQ ID NO: 15159 - DNA, 435 bp, Homo sapiens
gacgcagcaagaaggccctcacaagatgccaggccctcgaccttggacttcccagcctccaggaccaggagccaagaactgtctgtcctttataaattgcctgatctcagggtaggagatgtcagccagagggtacagaatcataaaggccaaaagcaaaagggaaaacacaacaaaacaaccctgcttgagagagctgaaggttcaatctcacgtgttaatttctggccatcacatggtgcttgagaccacttctggggtgttctccatacctgagaaaagtgactggggacagtttgcctctattcctgacatccacaggactgagaccttgcctttcaccaattagggtatgtaagggagagtcctgcaaaaactacttctgtgtcttttgtaaaattgctaccaaaacactagtgcccacaaattactggc

SEQ ID NO: 15160 - DNA, 372 bp, Homo sapiens
atggtgtggattaatgacattagttcctaggaggaggtccagggtgagtggggcttgatgcctctgtatttgattacattacattgatgtccaaatgcttcctgcctccatcatctgtctccttcctgtgacatcggagggaaaacaagggagaggatgttctaagctgtgagctcagttagcagggacaatttcttaatctgttcactctgcatatggtttattgaagctggatttctggactcatgactttgtcaggtcagtatcataaattattagatatagactttaatttgctattgaggtaccgaggatacatatgctgtttttgagagatgaaaacagtaattgtgctggaaaaatagaaagcta

SEQ ID NO: 15161 - DNA, 1355 bp, Homo sapiens
gcatgctcttaagtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtt

SEQ ID NO: 15162 - DNA, 1359 bp, Homo sapiens
  misc_feature (22)..(22): n is a, c, g, or t
  misc_feature (24)..(24): n is a, c, g, or t
aaactagctagtcgaggctggntngaatcggccggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtt

SEQ ID NO: 15163 - DNA, 2077 bp, Homo sapiens
  misc_feature (22)..(22): n is a, c, g, or t
  misc_feature (24)..(24): n is a, c, g, or t
aaactagctagtcgaggctggntngaatcggccggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtt

SEQ ID NO: 15164 - DNA, 1429 bp, Homo sapiens
  misc_feature (22)..(22): n is a, c, g, or t
  misc_feature (24)..(24): n is a, c, g, or t
aaactagctagtcgaggctggntngaatcggccggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtt

SEQ ID NO: 15165 - DNA, 1287 bp, Homo sapiens
gcatgctcttaagtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggattgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtt

SEQ ID NO: 15166 - DNA, 1239 bp, Homo sapiens
  misc_feature (22)..(22): n is a, c, g, or t
  misc_feature (24)..(24): n is a, c, g, or t
aaactagctagtcgaggctggntngaatcggccggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctgatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtgctcaacatgatgcccgaggagaagctggttgaggccctggctgcagccaccgagaagcagaagaaggccctggagaagttgctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtt

SEQ ID NO: 15167 - DNA, 311 bp, Homo sapiens
gcctggctaatttttttaattttggtagagacggggtttcaccatgttggccaggctggtctcgatctcttgacctggtgatccacctgccttggcctcccaaagtgctgggattacaggcgtgagccaccgtgcccggcctggtactgtagttttgttgaccccaagtgtatgtgttgggcctgtccagcattgagatgtggtccctgggctgaggcaggagaatcaattgaacccgggaggtggaggttgcagtgagctgagatcgtgtcactgcactccaacctggcaacagagcgagactccttctg

SEQ ID NO: 15168 - DNA, 364 bp, Homo sapiens
atgattaaatgaatattaccaatatttgacatgttttgtaatatgtagattatattcctgagagattaaataagaactctgtaggccgggcatggtggctcatgcctgtaatcccagcactttgggaggccgaagtgggtgaatcacttgaggtcaggagttcaagaccagcctggctaacatggtgaaaccccatctctcctaaaatacaaaaattagccaagtgtggtggtgggtgcctataaccccagctactctggaggctgaggcaggagaattgctggaacccgggaggcggagcttgcagtgggccgagatcgcgccattgcactccagtctggggaacaaaaagagcctccatctc

SEQ ID NO: 15169 - DNA, 356 bp, Homo sapiens
aggctgaaaaaacaatcacatcagaattagtaaggcaaaagacaaagagagagaaatgaaaacaagccagtattcaatggggctagggggaaaattacctgggcttcaggaattacaggagagttggggttttgagaaggtaaaaaagtgggccaggtgcggtggctcaagcttgtaatcccagcactttggaacgccaaggcaggtggatcacgagctcaagagattgagaccagcctggccaacatggtgaaaccctgtctctactaaaaacacaaaaattagccgggcgtggtggcgggcgcctgtagtcccagctactccagaggctgaggcaggagaatcgcttgaacccg

SEQ ID NO: 15170 - DNA, 283 bp, Homo sapiens
gtaatttacattttttagcaccctgtgaacacatccttggggatgaataatagcagcataaatataagctgaagtaggacttataagcaagaatagatgacaaataaggataggaccctaaggaacctagcatcacaggacatgaatgagtggaggctaaaggggactggaataccttaatcttgaaagctaagggattccttccagattctaatcattattcacctttctctcagaggaagattttgtgtcaggtatatgtcagctttttattctctaagca

SEQ ID NO: 15171 - DNA, 591 bp, Homo sapiens
ggctgactccgccagccttcacgttgggcaggcccggggtggctcactgtgggagcccttgtgaaataccctggatggggtggggcaggggctgcttcctgcaacccaaagccacaggatggttactccatcagtggaggaggccgactgggaggtctagaggggcctcgggccaggctcctcccagctgatggcctgccacctggaaggtgggggaactccctggtcagtcctgccaacagaccagagctagatggacggcccacccccagcttttcaaagttaggaggctgggagactcggggttccctgtagcctcctctctggccaggtcccccgtggggcccctgtgcacccagggagcagggggctttgtccgaggccggctcaggggaggtggctgtagaaggtaggaccctggaagatgcacacacagggtcactggctggccctcacctgctattggccaggctgggggctgcggctctcgtggggcgctgttggctggcgggccagggagtgcgggcgcggcggggaggcagaggcaatgtgctgagtcagcgtgactcgccaggaacagccgcgctctgg

SEQ ID NO: 15172 - DNA, 617 bp, Homo sapiens
tctgcattatgtaatacatatacaaactttgtgcttgttgttctgctcccctgggaaatgggcttcctgggggttctggactgctgaaggcaatgaacctctctgggttgtccagacctttgttttactttgaccagctgtgtgaggataaggtagttcaggaactaggagagcctgctgaatgtaaaattccatgaacagaagcaagagaatgacgagactgtgctagttctttcagaataacagcagcacccttgcactgcacagagttaaacatcccagatctggaaggaccctaccttgtgtcaccagcagctgcaagatctatattagggcctctgaaccacgagaagccatgcatctattcctgctctaggtcgaaatgtttatttctataaatttttgtggccttggctgaatgactcaggaactgagagtgagagtgggggtgtgtgcagaagtgttggcctagcaagatatccttaggatggcacatttgcaaggttggcccttagctggtttctggagaattggagttttggaggggtcccaccattcctaaaacttttaagagtggttcatcaaggccaaactgtttgttcaaacaatatggttta

SEQ ID NO: 15173 - DNA, 334 bp, Homo sapiens
aaagatctggaatttctttttttggacatttgttttgcagctttctacgtcttaaggcagagaatagccaggataaggtgccagctcaaagctgtgtgccaaccacgatgcaaacatggtgaatgtatcgggccaaacaagtgcaagtgtcatcctggttatgctggaaaaacctgtaatcaaggtaggaaaacagtctgacataaatacacaatcgaagacacctctatcactcccaaattaaaaatattcttatctcaaactactttccatggctatttttccaaaatatgtgagctgccattttgctgataaataaaaatatattaatgat

SEQ ID NO: 15174 - DNA, 347 bp, Homo sapiens
aggcttccagcgtgttgggacagtcagaggagttgtagatgattggaggaaaggaagaagacggcagcccagggtatttccccttctccctgcctcagatggcatctccagcatctccttcatgacctctgtctcctccgtgtgaccttccatcccctcaaagcaggactgcgccctgatgttgctaatctgataggttgctcctatttgtccttctataatcccaaagtcttcctaattggtttctcatcttgaacttcctctgtggaattacctaaaatgtattttgctttcctgactaggtcttgattaatatatacttcaaactaaaagttagtaaaaaaaat

SEQ ID NO: 15175 - DNA, 795 bp, Homo sapiens
gagtcctcctatagcttattaaatatgtatatttgaccacccatttagcagaaattcctattttctttgcctctctcttgaagtgtctgtttctagacttcacctctcctactcttcagtgcacatgtgtgtatgcatcctgccatctcaccactgtcagtgggagcacaactctcagtcccacccctactaacatgcaggcaccccaccatgccaccaggacgggcatgaatgctgggcaacactgtctctgccagcaaactacccctgctatgccaccactgcaatcatgtgcaagaatgcttccaccccactcccattggtgccccaccaaagccaatgcacatgcaccccaacatgccactgttgaggaccaaccaaaatattcaggacctgaactagacacttgaccaaatggaactaacagatatctacagaactctccaccaaaaaataacagagtatacattctgtgccattgtgactgctgagacacacaagtgagcatgggttctgctgtcactgccaagatgaagtgctttggccaacaccatccactgaagtgctgtggtcagcagactgagaactcctcaggccctccatcacaacaagttcccaacccaccaggggccagaaaacagagctggggacctgttaccagccccagagttagagtacacagcccaggagtgctgaggtgtgctttggtcccctaacatgttccagaagcaaaaccagtcaacccactttataccacaatcaaacctccaagggcatcaaagaagaaaaaggcaa

SEQ ID NO: 15176 - DNA, 871 bp, Homo sapiens
  misc_feature (868)..(869): n is a, c, g, or t
  misc_feature (871)..(871): n is a, c, g, or t
gggctgcaggaattcggcacggattccttccttaaaatctttcagtttcattctctgacattcttttttgctcgctggattccactgaaactagtctttcacatgctgctttcagatgcataccaaacttttgtgccttaacacactttgcaatacttttctctccactggggctttcttcctcattgttttgacttggctatctcctattgctgtcaggcttagtttaaatgtcatttcagagagacctttcttattcatcctgtctgtagtagatccttgtgcccatattctctatctcagccttttgtttgtgtcataggtcttaccacaatatgtaattgctttatttgttccccacaaaagaatgtaagagaccatgtatgcttgtttaccagtgtgtccctagctcttaaccgcatgcctggaacataactgttcaatatttatttgttggatgaatgagaaaccaaatattgttaacaagcttgttagattgtttaagattttcttctatagtagtctgagttgcatgaactttatgatatctacctcattagggctgtcgggctcacgaccttttcagatgattaatgttcccaaaatttaatattcaaataagagaaaaacaatacaaaagcaccattgggttgagcatggtggctcatgcctgtaatcctagcactttgggaagctgaggtggacggatcacttgaggtcagaagtttgagaccagggccgggcacagtggctcacgcctgtaatcccagcactttgagaggccgagttgggaggatcacgaggtcaggagatcgagaccatcctggctaacatggcgaaaccgtgtctctactaaaatacaaaaaannan

SEQ ID NO: 15177 - DNA, 1480 bp, Homo sapiens
  misc_feature (1477)..(1478): n is a, c, g, or t
  misc_feature (1480)..(1480): n is a, c, g, or t
tttgtttcttcctcagacctgttccccttttctttcctagtctttctccgcatttcaataaatgctgtctttccaatttctctagaggaacctaagagttatcttttctctccttttgcttgtggtgtcccctccagcccccattattttggccttgagtttaagttacattcactgctactgcaatgctcctggccaccaacactttttaaaaatctagaatattgcacaagtttcataaagtatctttatccccttactacccattatcctaagccattctcctcttagcgctaagaatggccttcttgccgggtgcggtggctcacgcctgtaatcccagcactttgggaagccaaggcaggcggatcacgaggtcaggagatggagaccatcctgtctaacacggtgaaaccctgtctctactaaaaaagaaaccctgtctctactaaaaaatacaaaaaaaaattagccgggcttggtggctggcacctgtacaggagaatggcaggaacccaggaggcggagcttgcagtgagccaagaacgcgccactgcactccagcctgggagacagagcaagactccatctcgaaaaaaagaatggccttcttaaaacataggtcatgatgattccttccttaaaatctttcagtttcattctctgacattcttttttgctcgctggattccactgaaactagtctttcacatgctgctttcagatgcataccaaacttttgtgccttaacacactttgcaatacttttctctccactggggctttcttcctcattgttttgacttggctatctcctattgctgtcaggcttagtttaaatgtcatttcagagagacctttcttattcatcctgtctgtagtagatccttgtgcccatattctctatctcagccttttgtttgtgtcataggtcttaccacaatatgtaattgctttatttgttccccacaaaagaatgtaagagaccatgtatgcttgtttaccagtgtgtccctagctcttaaccgcatgcctggaacataactgttcaatatttatttgttggatgaatgagaaaccaaatattgttaacaagcttgttagattgtttaagattttcttctatagtagtctgagttgcatgaactttatgatatctacctcattagggctgtcgggctcacgaccttttcagatgattaatgttcccaaaatttaatattcaaataagagaaaaacaatacaaaagcaccattgggttgagcatggtggctcatgcctgtaatcctagcactttgggaagctgaggtggacggatcacttgaggtcagaagtttgagaccagggccgggcacagtggctcacgcctgtaatcccagcactttgagaggccgagttgggaggatcacgaggtcaggagatcgagaccatcctggctaacatggcgaaaccgtgtctctactaaaatacaaaaaannan

SEQ ID NO: 15178 - DNA, 1426 bp, Homo sapiens
  misc_feature (1423)..(1424): n is a, c, g, or t
  misc_feature (1426)..(1426): n is a, c, g, or t
tttgtttcttcctcagacctgttccccttttctttcctagtctttctccgcatttcaataaatgctgtctttccaatttctctagaggaacctaagagttatcttttctctccttttgcttgtggtgtcccctccagcccccattattttggccttgagtttaagttacattcactgctactgcaatgctcctggccaccaacactttttaaaaatctagaatattgcacaagtttcataaagtatctttatccccttactacccattatcctaagccattctcctcttagcgctaagaatggccttcttgccgggtgcggtggctcacgcctgtaatcccagcactttgggaagccaaggcaggcggatcacgaggtcaggagatggagaccatcctgtctaacacggtgaaaccctgtctctactaaaaaagaaaccctgtctctactaaaaaatacaaaaaaaaattagccgggcttggtggctggcacctgtacaggagaatggcaggaacccaggaggcggagcttgcagtgagccaagaacgcgccactgcactccagcctgggagacagagcaagactccatctcgaaaaaaagaatggccttcttaaaacataggtcatgatgattccttccttaaaatctttcagtttcattctctgacattcttttttgctcgctggattccactgaaactagtctttcacatgctgctttcagatgcataccaaacttttgtgccttaacacactttgcaatacttttctctccactggggctttcttcctcattgttttgacttggctatctcctattgctgtcaggcttagtttaaatgtcatttcagagagacctttcttattcatcctgtctgtagtagatccttgtgcccatattctctatctcagccttttgtttgtgtcataggtcttaccacaatatgtaattgctttatttgttccccacaacgcatgcctggaacataactgttcaatatttatttgttggatgaatgagaaaccaaatattgttaacaagcttgttagattgtttaagattttcttctatagtagtctgagttgcatgaactttatgatatctacctcattagggctgtcgggctcacgaccttttcagatgattaatgttcccaaaatttaatattcaaataagagaaaaacaatacaaaagcaccattgggttgagcatggtggctcatgcctgtaatcctagcactttgggaagctgaggtggacggatcacttgaggtcagaagtttgagaccagggccgggcacagtggctcacgcctgtaatcccagcactttgagaggccgagttgggaggatcacgaggtcaggagatcgagaccatcctggctaacatggcgaaaccgtgtctctactaaaatacaaaaaannan

SEQ ID NO: 15179 - DNA, 395 bp, Homo sapiens
  misc_feature (8)..(8): n is a, c, g, or t
  misc_feature (14)..(14): n is a, c, g, or t
  misc_feature (57)..(57): n is a, c, g, or t
  misc_feature (78)..(78): n is a, c, g, or t
  misc_feature (101)..(101): n is a, c, g, or t
attgtatngggggnatccccctgagagcccttgcccccttaaaatccaattggccanttccccccagcaatgggaacngggaaaccttgggatttcccccnaaaaaccatattccgctgaattaatccatttccagaggtgttccaaatttaggtagcaagaatccagctgaaaactttacaagaggttcactttcctgctgcaccccgagtgatcatgaaaatattcaggcattttcagatgaatttgccagaagggctaatggaaatctcgtcagtgacaaaattccgaaggctaaagatacacaaggttcagtaaagcttctaaattgagaagtgatttctagttgctaagtaactgttcattggcaggtaaaagacagtagtgataatttt

SEQ ID NO: 15180 - DNA, 5439 bp, Homo sapiens
tataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtaagccttctgctagaatgcagtttctggatggtggaaataagttctgtcatggtcctatataaaatccattttcattcacttcctatcacatttttttaaacccagaattagaatttgtatggtaattagtagttctagattctactcatgtgaccataattactgaggcattaagattcttgtgtcagtgattacaatatttgattgtaatatgatagaacactaaagacatatatttactttgtgaagcaagctaatacaaattcaaagatatggctttaaaattggatttgatagctagcaaattccacagagagccatgcagaggctccttagatcaggaccatgttactctgccccattattcacagatcaacagtgcttccttgataaagccagcaggccttttctcgtttatcataattattttgggcaggtgaatgtgatgattcgtgcctgtagtcccagctattgggaggctgaggtggaaggattgcatgagcccaggagtttgacgccagtctgggtaacatagtgagatcctgctctcaaataaaaacaaccaattattttggcatcttcttccatttttaaacatttttgatattgctgtttgatattatattttccttgacttctctagcaaaattattatgatttttttttccttgactaattttcttttcatttttgcaggcacgctgtttctcttccaaacccctaattctagctttattcacgccatttatgcttaaacggtcttttgtctctgtacctcaccagggaatatatttacccttcttggattcaactattagttcaatgtcgatagctcccaaatcaacattaccaacctgggtctttgactcaagctctagaacatactcccagtggcctaaaaaaatctccacttgaggctgggcacagtggctcacgcctgtaatcccagcactttgggaggccgaggtgggtggatcacgaggtcaggggttcaagaccatcctggtgaagatggtgaaaccacgtctctactaaaactacaaaaattagccgggcatgttggcaggtgcctataatcccacctacttgggaggctgaggcaggataattgcttgaacatgggcggcagagattgcagtgagccaagatcacgccactgcactccagcctggtcgacagagtgagactccgtctcaaaaaaaaaatctccacttgaatatctaactgcaaaatcaacttctctaaaatctaatgcatcatacgtaagtaattctctttccctttccttcctcatttctgtttttggttctaccactttctgagtaaagccggagatctttgatccaccataagtctgccagtaagacctacattttctttgcaaatttttcttactctctatttgaactgccaacactgtttattcatgttgttaagtacatcataatttaaaaagattcaaagtgccctacaaagatataaactataccttcagataaaataaatatacaaagaaaaatggttaaagagaaaagaatggcagggaaaataagataatacagacgaactgctagttctcaaaaatatataacatgaggttaccaatttgtccctgagcttcctagtagacaaagcaagaagtaaacattcaggtacaagactcataatgtccgtaaatcaaaaagcaaaccatttgataaggaggctcacagctcctcacaatactgagactgactcctgagagatttctcttgtggatcaagtactagagaatatcctcaacgtcatcctcacaataaattaaatatcaacttttatatcactgtttttttttaatgtaaaactggttgaacaaaaccgatgcctgattgaatgaaaacaattctatgaggcaccaagacaatatgattcaagtatgcagctctatgatggtctatttctgagataacaagtaagtctcactccaagtaccaattactactaactggtagtggctgattggcacattgtgatgagatgctaagtttagattgagcaggaatgaatgttctgcttgaccagcaatatctacagtgggccctgtggatgcctgctgtgtattggcagaccctggccagagaattgatttcaacacttttttgcagtgaaaccttttttttcaataaaatcttatgtgaaatcccagtgtatgaaccagataaaagcagaggtgtgggtagtacttaaggtgcctccatggaggtccctagaattgtgaaaataacataaaaaatgggtggtctgtcatcctctatgactattatgtcttatgattaaggtttttaatatccataagccttccacttagattcaacaattgtgccacttttgctttctctccctgtctgtttttgctgaagcatttgaaggtaagttgcagacatcatgatactcctattttagcaagtatctcccaattaaagacat

SEQ ID NO: 15181 - DNA, 253 bp, Homo sapiens
ctattacagcataaactattacagctaactattcgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatatgctgtaatagtttatggtgtaatagttatgctgtaatagtgttaggctgtaatagt

SEQ ID NO: 15182 - DNA, 458 bp, Homo sapiens
cttttggggtctttgctgtctttgctctttgggtctttgctcagaaagtggtagaaccaaaaacagaaatgaggaaggaaagggaaagagaattacttacgtatgatgcattagattttagagaagttttttgcagtgaaaccttttttttcaataaaatcttatgtgaaatcccagtgtatgaaccagataaaagcagaggtgtgggtagtacttaaggtgcctccatggaggtccctagaattgtgaaaataacataaaaaatgggtggtctgtcatcctctatgactattatgtcttatgattaaggtttttaatatccataagccttccacttagattcaacaattgtgccacttttgctttctctccctgtctgtttttgctgaagcatttgaaggtaagttgcagacatcatgatactcctattttagcaagtatctcccaattaaagacat

SEQ ID NO: 15183 - DNA, 5546 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15184 - DNA, 5415 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15185 - DNA, 4489 bp, Homo sapiens
gccacccttgggtcaaagctgggagagaaaagaggaaaaattttaaaacagaacaaaatggaaaactgccccacttagcagattgcttctgcaagttttggcacctttcttcaatctgtctgctgttattgtaacttttcagagctcttgggtggtggctttttgtatttgtcctgtttttagttgtaatcaacgggagagataggctatagtacgctaacttcaccttggtcagcaccagagttcatgtttgatatggattctatgttctaattcttttttcttaaacagatcatcactgaggctgaggagcagggccaggttaaagaccagaggtcacagaaagagagggagagggaagacatccaagagggtcccatgtgagcaggatacccaagtcattcttgctgtggctgactcggttattgactttacttcttttcttttcaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15186 - DNA, 3517 bp, Homo sapiens
cggccccactacctcatctgcggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15187 - DNA, 3389 bp, Homo sapiens
gaggatcccggctcttagccagtgttgtgacaactgtcatgactggggaaaaccttggtgtcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15188 - DNA, 2863 bp, Homo sapiens
tttctgaatgcagaaagctgccgtctggcattggatttgctgtttagtgtgcttttatttatgaaacatagtgatcatgtttcatttgctgtatattggcaagtgctcttggaactggcagaatattatcctttattaatttgcagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15189 - DNA, 5492 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtactctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15190 - DNA, 5479 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15191 - DNA, 5357 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagaga

SEQ ID NO: 15192 - DNA, 4879 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtaagccttctgctagaatgcagtttctggatggtggaaataagttctgtcatggtcctatataaaatccattttcattcacttcctatcacatttttttaaacccagaattagaatttgtatggtaattagtagttctagattctactcatgtgaccataattactgaggcattaagattcttgtgtcagtgattacaatatttgattgtaatatgatagaacactaaagacatatatttactttgtgaagcaagctaatacaaattcaaagatatggctttaaaattggatttgatagctagcaaattccacagagagccatgcagaggctccttagatcaggaccatgttactctgccccattattcacagatcaacagtgcttccttgataaagccagcaggccttttctcgtttatcataattattttgggcaggtgaatgtgatgattcgtgcctgtagtcccagctattgggaggctgaggtggaaggattgcatgagcccaggagtttgacgccagtctgggtaacatagtgagatcctgctctcaaataaaaacaaccaattattttggcatcttcttccatttttaaacatttttgatattgctgtttgatattatattttccttgacttctctagcaaaattattatgatttttttttccttgactaattttcttttcatttttgcaggcacgctgtttctcttccaaacccctaattctagctttattcacgccatttatgcttaaacggtcttttgtctctgtacctcaccagggaatatatttacccttcttggattcaactattagttcaatgtcgatagctcccaaatcaacattaccaacctgggtctttgactcaagctctagaacatactcccagtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15193 - DNA, 4440 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtgaatgtgatgattcgtgcctgtagtcccagctattgggaggctgaggtggaaggattgcatgagcccaggagtttgacgccagtctgggtaacatagtgagatcctgctctcaaataaaaacaaccaattattttggcatcttcttccatttttaaacatttttgatattgctgtttgatattatattttccttgacttctctagcaaaattattatgatttttttttccttgactaattttcttttcatttttgcaggcacgctgtttctcttccaaacccctaattctagctttattcacgccatttatgcttaaacggtcttttgtctctgtacctcaccagggaatatatttacccttcttggattcaactattagttcaatgtcgatagctcccaaatcaacattaccaacctgggtctttgactcaagctctagaacatactcccagtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15194 - DNA, 5393 bp, Homo sapiens
  misc_feature (5375)..(5375): n is a, c, g, or t
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagaaccgtcgattcgagggantcctctggagtcgccgcg

SEQ ID NO: 15195 - DNA, 4910 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtaagccttctgctagaatgcagtttctggatggtggaaataagttctgtcatggtcctatataaaatccattttcattcacttcctatcacatttttttaaacccagaattagaatttgtatggtaattagtagttctagattctactcatgtgaccataattactgaggcattaagattcttgtgtcagtgattacaatatttgattgtaatatgatagaacactaaagacatatatttactttgtgaagcaagctaatacaaattcaaagatatggctttaaaattggatttgatagctagcaaattccacagagagccatgcagaggctccttagatcaggaccatgttactctgccccattattcacagatcaacagtgcttccttgataaagccagcaggccttttctcgtttatcataattattttgggcaggtgaatgtgatgattcgtgcctgtagtcccagctattgggaggctgaggtggaaggattgcatgagcccaggagtttgacgccagtctgggtaacatagtgagatcctgctctcaaataaaaacaaccaattattttggcatcttcttccatttttaaacatttttgatattgctgtttgatattatattttccttgacttctctagcaaaattattatgatttttttttccttgactaattttcttttcatttttgcaggcacgctgtttctcttccaaacccctaattctagctttattcacgccatttatgcttaaacggtcttttgtctctgtacctcaccagggaatatatttacccttcttggattcaactattagttcaatgtcgatagctcccaaatcaacattaccaacctgggtctttgactcaagctctagaacatactcccagtggcctaaaaaaatctccacttgaggctgggtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15196 - DNA, 2318 bp, Homo sapiens
atcccacatagtgtctgaccacgactggccgtcgtatacaagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15197 - DNA, 5430 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15198 - DNA, 5678 bp, Homo sapiens
  misc_feature (5486)..(5486): n is a, c, g, or t
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgagcaatggggggagaaagaggaatttatcttcttgacctctagtcccttgattgaaaatttaactctgatttaaggnagccgttgggtaagccagattccacatcccactaaactgcctggaagaggtgggaggagagcagccattaaggtatgaggtacagagtcccatcaggtgagacccatgtctgtagccactgaggttcctgttgcaacaggtgagatgtgatcttcccaaagccgcagcttcttccgcaggaggctgagacag

SEQ ID NO: 15199 - DNA, 1887 bp, Homo sapiens
aaaatccgcggtaccggttcgcatgttcctattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15200 - DNA, 5189 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttcttcagcttctctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaaggggtttgtattttctggaaggagagaataacagtctataacaaaggacaccgt

SEQ ID NO: 15201 - DNA, 1262 bp, Homo sapiens
gagctcggtaccgaattcatccagcgtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15202 - DNA, 1333 bp, Homo sapiens
  misc_feature (173)..(173): n is a, c, g, or t
gatttcaggctgcagaatggatggtgtgtaacaggcatgaaaatttcatcttgtaaatctccattagagactttgggtgaccaggtgcgttaccaatgagcagtaatatttttaaagaactcttcttttctaagaggtagatctcaacaatggcttaaaatattcagtaaacncaggtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15203 - DNA, 1288 bp, Homo sapiens
  misc_feature (56)..(56): n is a, c, g, or t
cgtgcagtcatacggactatctccagatgtgatctctgatgtatagtcacgctgtncttattgccaaataatttcccacatacctcacacgcatatggcctttctccagtgtgaactctctcatgaacgagaagatgatacttcctgttaaataatttcccacattccctacaattgtaaggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15204 - DNA, 1446 bp, Homo sapiens
gtgagccaccgcacccagccctctctcttcctcaatgcactctgcttcttccgttcttccgaaacattcagctgactgtatccaggcttcctggactcctgggaccccacgtcctgcaccccggcttctgactcatttcctaagggcccctttgtgtatcataaagggtttgatttttatagtcacatttacaaccatcttgagatttttatttttttgaggcagggtctctctctgtcatccaggctggagtgcagtggcaccatctcggctcactgcaacctccgccccctgggttcaagtgattctcccacctcagcctcccgagtagctgggactacaggtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtactctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtcaaaaaaaaaaaa

SEQ ID NO: 15205 - DNA, 3466 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgcagtcagtctttagtgagggttaataatccatatgactagtag

SEQ ID NO: 15206 - DNA, 4779 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtaagccttctgctagaatgcagtttctggatggtggaaataagttctgtcatggtcctatataaaatccattttcattcacttcctatcacatttttttaaacccagaattagaatttgtatggtaattagtagttctagattctactcatgtgaccataattactgaggcattaagattcttgtgtcagtgattacaatatttgattgtaatatgatagaacactaaagacatatatttactttgtgaagcaagctaatacaaattcaaagatatggctttaaaattggatttgatagctagcaaattccacagagagccatgcagaggctccttagatcaggaccatgttactctgccccattattcacagatcaacagtgcttccttgataaagccagcaggccttttctcgtttatcataattattttgggcaggtgaatgtgatgattcgtgcctgtagtcccagctattgggaggctgaggtggaaggattgcatgagcccaggagtttgacgccagtctgggtaacatagtgagatcctgctctcaaataaaaacaaccaattattttggcatcttcttccatttttaaacatttttgatattgctgtttgatattatattttccttgacttctctagcaaaattattatgatttttttttccttgactaattttcttttcatttttgcaggcacgctgtttctcttccaaacccctaattctagctttattcacgccatttatgcttaaacggtcttttgtctctgtacctcaccagggaatatatttacccttcttggattcaactattagttcaatgtcgatagctcccaaatcaacattaccaacctgggtctttgactcaagctctagaacatactcccagtggcctaaaaaaatctccacttgaggctgggcacagtggctcacgcctgtaatcccagcactttgggaggccgaggtgggtggatcacgaggtcaggggttcaagaccatcctggtgaagatggtgaaaccacgtctctactaaaactacaaaaattagccgggcatgttggcaggtgcctataatcccacctacttgggaggctgaggcaggataattgcttgaacatgggcggcagagattgcagtgagccaagatcacgccactgcactccagcctggtcgacagagtgagactccgtctcaaaaaaaaaatctccacttgaatatctaactgcaaaatcaacttctctaaaatctaatgcatcatacgtaagtaattctctttccctttccttcctcatttctgtttttggttctaccactttctgagtaaagccggagatctttgatccaccataagtctgccagtaagacctacattttctttgcaaatttttcttactctctatttgaactgccaacactgtttattcatgttgttaagtacatcataatttaaaaagattcaaagtgccctacaaagatataaactataccttcagataaaataaatatacaaagaaaaatggttaaagagaaaagaatggcagggaaaataagataatacagacgaactgctagttctcaaaaatatataacatgaggttaccaatttgtccctgagcttcctagtagacaaagcaagaagtaaacattcaggtacaagactcataatgtccgtaaatcaaaaagcaaaccatttgataaggaggctcacagctcctcacaatactgagactgactcctgagagatttctcttgtggatcaagtactagagaatatcctcaacgtcatcctcacaataaattaaatatcaacttttatatcactgtttttttttaatgtaaaactggttgaacaaaaccgatgcctgattgaatgaaaacaattctatgaggcaccaagacaatatgattcaagtatgcgtatgctcagcgcggggtaccgagctcg

SEQ ID NO: 15207 - DNA, 1224 bp, Homo sapiens
gtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatcattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaaggtgagtgtcgcttttacagaacaccaccagggcactgtgactttacttagtcagtggctctctcatggagggctgaagaaagataaggaccaaggtgagaatcaagggagagaatcccatgccttccacccctgccttgaaacaattttccttagataattgggcttcttaccaaatcatttactaatagagatcggccaattatttgtgagaactgaaagggtatagaggtcagattgctagatttccagtaga

SEQ ID NO: 15208 - DNA, 271 bp, Homo sapiens
gtagtcatcttagttgtctccaattgtgccaagcccagtgcctcaaatatagtaatcattgatgaatgctttttgttaaaatttgaaacaaatttttggttttgtctttaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagc

SEQ ID NO: 15209 - DNA, 332 bp, Homo sapiens
accaaaccctctggatcagaaggcacgaagatgtagacagcgtctcttatgccttatgtaggaagtgcctaatgatttctttgcaaattctgactagtataagtcctaaacaagaggcaaatgtcttagtgtcgtccaagtgctataaatgaagttaaatggggaacatacggttaacatttctataggactgtatgtttgccaaaaggttaataatcacttgttccttaatattcataacatccctctaaagcagaatttcccacactgggactgggaggcctcagggatggtggaggaatttcaagagggtcatggggattggagctgta

SEQ ID NO: 15210 - DNA, 291 bp, Homo sapiens
tagggaaaggataccagcacattttcttagagccagcttcctttagtggaggttgatcttcatgagacttttagattcacttcagacatagatagcttttaaaatttttggttgcatgttttttctttatttaactaatttccttactgttattatttgagctgctctgaaacggaaataaccaccatttttcagtcctcagcacaatttaagtcaatttttctatttttattttttattgtcaagtatatatacagaagggtgtataaaacatacattttaaaaaattat

SEQ ID NO: 15211 - DNA, 618 bp, Homo sapiens
gcaattctcaagccttttacactgcaatcattgtaaaataatgctcagatatgcaaaactttcttaggtataatttccagttcactaaccacaactcctctttttctgttaataaagcatttcagaatatgagtaaatcacttgcaaacgttgctattttaactgttagcaacttacctccttgaccttgcccaacaattttatcctgtgcctttcttaacaacttagtcttatggccataccctacaccatcaaaccatgccatacccaatcactgcaactcctgtgtaatctcacttcattcctttcagtctctgagtactacctcctatttttccagcttgcacccctttagtctgttctcaacatagtagccagtgaacctatgaacacttaagtctagctttgtcgcccaggctagagtgcagtggcgggatcctcattactgtgttggtcaggctgatctcgaactcctgacctcaagtgatccacccgcctcagcctcccaaagtgctgggattacaggcgtgagccagtgcacctggcctatgtttgatcttattcagagtaaaaaccagagcccttaaaatggctatgagaccccatatgatctaaacc

SEQ ID NO: 15212 - DNA, 307 bp, Homo sapiens
tctggagcacatggccttgccttgacctcttagattgttactaacctatataaacccttcaataattggtaaaaattaattttttaagctcatttacatatttttaccaaagacaggtccgacaattttgtaacctgcttttctacttacacgtttgtgtcattaaatatttttctctaatattatttaaatgctgtatggtgtactataatatagatttaccattatttatttaatactgaagttaatatatagtcatgatctaagctccatcctaattttgtaccatatctcatttagtcctcac

SEQ ID NO: 15213 - DNA, 1350 bp, Homo sapiens
agcggctcttccgcggccgcggtgggaatggaaacatctgccccacgtgcaggaagccgggtggtggccacgacagcgcgccactccgcagcgtaacctcgcagatcccctgcgtgtgtcctcgcaagactagctcaccgaaatggccgcgtccagtcaaggaaactttgagggagatattgagtcagtggaccttgcagaatttgctaagcagcagccgtggtggcgtaagctgtttgggccagaatctggactctcagccgaaaagtatagcgtggcaacccacctgttcattggaggtgtcactggatggtgcacgggttttatattccagaaggttggaaagttggctgcaacagctgtgggaggtggattttttctccttcagcttgcaaaccattctgggtacatcaaagttgattggcaacgagtggagaaggacatgaagaaagccaaagagcagctgaagatccctaagagcactcagatacctaaccaggtcaggagcaaagctgaggaggtggtgtcatttgtgaagaaaaatgttctagtgactgggggatttttcggaggctttctgcttggcatggcatcctaaagaagatacctcattttcattgttcctggttttttccagccagcagcctctacactccatcacaggacattgagtccctcctcctcttctcccatgccttcctccctgctgtggcaaatccgagtggcttctataagcatccgttggtacaagttaatgtggcaccatgagcctgactggcttctataagcatctgttggcacaagttaatgtggcaccatgagcttgatggcggcagaagagacaatagtccttagctcttcttccagtacgccccctacttagtcagtctgtaggtcatcaagaaggtccctctacccctatgcaagacacttacaagaacacattgcaagatagctgaccgtggaggatgagtggatcctgaaatgttgtcccgaactgttgatttggaaaagaaataagcacatagataaccttattgtgtgctgcatggaaaggaactgaatacaattgcctttaagcattaaaaaaaaaaggatgaaaaattggggtgtcacatttgcaaaatggatggacaaatgtggtcagggcagatcaaggatcatttcactgattacaagccaggtgcacgccctgtcccaggcatttagaagaacaggggccagacttacatgtggtcacagttttggaagagaagatctaattggctgaacttatgtcatatgctgcttgctggaggttgtgggaacttccatttatacccttttgattagaagtacaggtgacaacct

SEQ ID NO: 15214 - DNA, 2329 bp, Homo sapiens
gcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgacgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 15215 - DNA, 2371 bp, Homo sapiens
gcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 15216 - DNA, 2378 bp, Homo sapiens
  misc_feature (2353)..(2353): n is a, c, g, or t
gcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgccgnattcggtaccgagctcgattctatc

SEQ ID NO: 15217 - DNA, 549 bp, Homo sapiens
tgagattgtgccgcggcactccagcctgggcggcagacagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 15218 - DNA, 1601 bp, Homo sapiens
gcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 15219 - DNA, 248 bp, Homo sapiens
cccaatctgtgcagctgacaaatagaaagaataaaggatcagaattgaaggcaggctataagagtatctacgaaattcttaaaaaccagcgagtgattggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 15220 - DNA, 401 bp, Homo sapiens
gaatttcagtacactatctgcctgggggacacacctgttggggaaggggatgaagtgtgggccctgaccatgggatcccctggtcgtatcaccacctgcgcctctcaagtgctgccaggcacacagagtcatggacaggactctacaggcacaattcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaatacataacatgaatacttaaataaatttatttatgcatgtatgtatgta

SEQ ID NO: 15221 - DNA, 403 bp, Homo sapiens
tcacatcatcctttacaactttacctccaacccttttattcctgctttcgccatccacgttggcatctcatgctagactaggactgaaaacccctaactcctctacctactggtagaaactcacatttctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacaga

SEQ ID NO: 15222 - DNA, 285 bp, Homo sapiens
gtacagctgaggaaatagattttatgaggacaaactgcacaagatgttatgactagtaaggagtagaatcaggatttgaacctaagtcagaatagcttcaaagacaactctttatattccagtgtgttgccttttttgagtaggaagtataatgcagtacgatggtgctctaattgtcctgaaccttagctttttaaggaagaagtatctcaggagagggggaggctgaatggacagggctttgaaatcccctactttaagctgaggagctcagcccttttacat

SEQ ID NO: 15223 - DNA, 1021 bp, Homo sapiens
ctccactgcatgattcttctgctgattttgtctggagttaattcatctggcttcagtgagctaggaacacatctggggctgaatcatccaggagggtctgttatcctgcaaggttccagccacatggtctctcatcattcaatagtctgggtcaagcttttgtacagcatggctgatagcttccaccaagaggaaaaactccaatgtgcaaaggtttaccaagtttctgctggcatcatgcttgctaatgtcacattggtcaaagcaaatcacaaggttaaggcccacatcatagggaaatgaagcccagaagttgtggtttactgggggtcatcattgtttaccattatctcctctcttaccctttatcttcaatttttccttatttacctgtcttttcccttcagcacagaagggaaatctggggccgggcatggtggctcatgcctgtaatcccagtacttccagggggctgaggcaggtggatcacctgaggtcaggagtttgagaccagcctgaccaacatggtgaaacccccatctctactaaaaatacaaaaaaattagctgggtttggtggcgcatgcctataatcccagctactcaggaggctgaggcacgagaattgcttgaaccctggaggtggaggttgcagtgagcctagatcacgccactgcactccagcctggaaaacagagtgagactctgtctcaaaaaaaaaaaaaaagagaaagaaagaggaaaggaaaggaaaggaatctgaatgatcacattcaaatacaaatataaatttcctgtaactgcatattccctttaagctaccacgttactctcctttgcacagccaatcatttttagagtggtctacactcactgccctcacttcatcactgcctgttcattctccaatcactgcaggctggcatccaccgacaccacagcaacaaaactgctctccctgagatcctcaataacctctgcacttccagaggcaatggataatttcctgaccttgtttgctt

SEQ ID NO: 15224 - DNA, 228 bp, Homo sapiens
gcctcaggtgagcagctttagtcaatgttgtgaattttagattttaattagacatgcaacagtttcactacctttcaggatttttgtcctgtaacagaggctcttgctttttgacagagaggtaggcaggtggagaggttatcctgctgctgcagttctcaagttgttaagtttcctctggaaggctaacccttgttgggaactaacagtttcaataccagcaagtct

SEQ ID NO: 15225 - DNA, 614 bp, Homo sapiens
aatatccaggctgactagtggttcgagaggagaaagaaatatttgtcttttacagggtatggtaacttccgcagacagcaaaaccataggctgtgtttctacacactcaataggaagtaaaaactgaaactgatagctatgtggttcagctctcataacctagagtcctatgttgaagatctgtgagatctagatgattgccctgattttctgatgctctttgtatgggaagcatgccctcaaagatctaaggtaaagtattaccttgaaagataagctattcttctcactgattggattggatttgattcattgaatttgagtaagtaattaagtgatgattccacttgggtttctcaaagggcaagaatgagaaagagaagaattaaagtctacttagttggttttctcctgaaatgattctgattcctaaaaaacatgaatgagtctatagcaaaatggcattgccgaagccctgatttacagaccttacaggatgcagtgtatgtatgtttctggcctgctgtaactgtatataaatataacatttatgcattatcaaatagtaacagactattacaagcattcatatatatgttgaaccaattaggata

SEQ ID NO: 15226 - DNA, 492 bp, Homo sapiens
aggcgaggataaaaaatgtgcccgaggccacaaagcacaaggatagagtcagaatttgaagccagcttttccaaagtctaagtcttgctccttccctgtaccttgcaagctttcatccctcagtggataccagggctgaggaaactgatttgtaacacgttcctgtcacagagttttggctctacatttaagacataaaacttggcctggcgcagtggctcacgcctgtaatcccagcactttggggggccaaggcaggtggatcacctgaggtcaggagttcgaaaccagcctgaccaatatggcaaaaccctgtctctactaaaaataaaatttagccgggcgtggtggcgggtgcctgtaatcccagctactcaggaggctgaggcaggagaactgcttgaagacaggaggcagaggtagcagtgaacaaagatcgcaccactgcactccagcctgggtgacagagcaagactccatctcaaaaaaaaa

SEQ ID NO: 15227 - DNA, 934 bp, Homo sapiens
ggcagccaagacagaatgaaagccaagtgagaggggaaacctcgtatgaaaacatcagatctcatgagacttattcactaccacgagaacagtatggaggaaaccgtccccatgattcagttatctcccacctggtccctcccacaacacgtggaaattatgggagctacagttcaagatgagatttgggtgaggacacagccaaaccatatcagggtctatggcagggaatgacttgacccaatttgcatgacaagaggcttagtgtggctgccacacagagaaggtaggagggagtgagaagcaggccagccgtgtcatgtagctttctgagtgagatcagtcacctaaaatggaaaagcattttggaaatataagtggtgagtccagttgtaaagtgtagtaaaatgtgacacgtggttgcctccagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagt

SEQ ID NO: 15228 - DNA, 1445 bp, Homo sapiens
ggtatgcatctgagatataaagaagaaaaagccacagctccttccttcgtgatgctcatagtctggtagaggaagaattcagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctttctgaagtgatgaagaaacttcctctatcctggtttgaaaggggtaaacagcagtctttcctgagccacatggctgagctccccacccagcttccatttcacattgcttctttccattgagaagtcaaaggtcccttcagcaaagtattgcaaccagtgaaaaagagtttctataaaagaaaaaaatgtgtttgtttttatcctgacatagttactcttgcagggaacattttagtttatttcaaagtatgagcctttttacaccatcttttaacattaattttttaaaatatattttttggctcctctg

SEQ ID NO: 15229 - DNA, 2330 bp, Homo sapiens
ggtatgcatctgagatataaagaagaaaaagccacagctccttccttcgtgatgctcatagtctggtagaggaagaattcagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatatcttcagctcctttgttctctgttcccaaagtcagctgtctcctctgctcaggcttctacaaacaggaaggggctgagtgatgttttggtaactcgttgaacccctggcttaaagtctcactcccctatcagagtgtggttcttgccaaagagctgtgagtgtaaacactgcttgaaggcccaggcccgaggacaccata

SEQ ID NO: 15230 - DNA, 1338 bp, Homo sapiens
agcggagctggaagagcctggggccacctgtctggtcagagtctctctgctgtgggcctcttggagccaggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagt

SEQ ID NO: 15231 - DNA, 321 bp, Homo sapiens
tccttcgtgatgctcatagtctggtagaggaagaattcaggtaagcaaaaaagccagtcatatgatcatctctttctgcattttgctcaggatcaacttctacacgactgatctatagcttatggcccctgtcctctttcctttcttgctaagtcatagacataccagttgaatttatacaattcatctgtggggaaagtttcacaaggctgatttttccatatatcttctctgtataatttattgttaataaattcatttaagtattttaaaatcctaaaatatatgtcagtaaagggtgctaaaatgttaaacaaatat

SEQ ID NO: 15232 - DNA, 1142 bp, Homo sapiens
agcggagctggaagagcctggggccacctgtctggtcagagtctctctgctgtgggcctcttggagccaggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatatcttcagctcctttgttctctgttcccaaagtcagctgtctcctctgctcaggcttctacaaacaggaaggggctgagtgatgttttggtaactcgttgaacccctggcttaaagtctcactcccctatcagagtgtggttcttgccaaagagctgtgagtgtaaacactgcttgaaggcccaggcccgaggacaccata

SEQ ID NO: 15233 - DNA, 1669 bp, Homo sapiens
cattacccatttttgtgtccataaaattgtccataattttaagagctgtatgttctctgtcaccaagttcaccttaatgagaagttgacattttctctgcctctttgccatttgtaggtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatatcttcagctcctttgttctctgttcccaaagtcagctgtctcctctgctcaggcttctacaaacaggaaggggctgagtgatgttttggtaactcgttgaacccctggcttaaagtctcactcccctatcagagtgtggttcttgccaaagagctgtgagtgtaaacactgcttgaaggcccaggcccgaggacaccata

SEQ ID NO: 15234 - DNA, 1085 bp, Homo sapiens
ggtatgcatctgagatataaagaagaaaaagccacagctccttccttcgtgatgctcatagtctggtagaggaagaattcagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattaaaagcaccaagctcctctgatggagttctcttctgcagaaaccaatgagtgaggcaggatctgtttcagcaaaggccctggtcaggtatcagcatcacacagtgttcctgctggagagaggagacagcatgcaaagtcaagattcaggtggaactgaactgctagggtggattttgttgctgtccctacccttccagaagccctatagcattacagtgctgaatgagaaagagagttaacaaagttattagccccaagacaaaaactagttcagaatttaaggaaaataaacatattagacattgga

SEQ ID NO: 15235 - DNA, 4819 bp, Homo sapiens
tccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtagtaagtaaaaacaaaaacaaaaaaaacaccaaaccaagtctaggctagctttgctttgttgttcacctcctcagatctattttcccagtgtccatttctgatgtaatagggtattttctttgtgaattgcatttttgtgttggttttctgcacagatctggtgagaacacagataaagtgattatttgtgcataactccatgaacatggcagtgctatgacttttctgactactcttaaccagtgagggctacctagactcaggtgcaattccttagataatcatcattcaggaaaaatataagtagtcctatttatccatacttagcaaccaacaaacaaattgaactctctcttagactggatttggatgtctgacataattttaaaaagcagaaaatgaaagccaatgaatgccttgggtatatgcatcagaacccaagaaaaagtccatgataccaagggaagggaattttgttaatgcattaaattctatgttttgtgaaggcctgaaacaggcaaatttgtgatcagtagtctctctggagagataaaggaaaaagagaatctgtacattcatttctccttcctaaaatacgatgatctatgtcttcttgactacttagctttgagtttgatatagaaagagtataaaaaatatgtgcagaatttgggagtgagagtactagaaattcctttaataaatctgttagtatgaatccaagcaattgaagagaaaccgctcttcaaccatctgtagaacacttccccggtatcactacaaagaactttcttccagctatcatgggagaaccaggtgtagctcccgcttcatgtgtaaaataatgatgccctcatgccaagcctgaaattcacattaagaaaatgcccagtaactttacagagcaaaattttaaattttttttttatacattgcaccctttatctctaatggctaaaatctttgaacaactactaagtaactgattacaaataaattaccgagaaagcaagattacgcatggtaagcggagagaattttcactgtagtgtcatcccctcacaggcttgtgtcataggtgctgtgccaggcagggtgatcgcagtgtaaatagccattgaatgattgcgattcccagcatccatctaaaaagcaatactctgataatttggataaagcaacttcctgcttcttataaatgcgcagtcaggtgtcccaatttataaatcaacccagtttacttgagcttgtgaataggcctggacactgatttgttaagcgctagatgtggtaaatgccatgaaaattggccactttgtaaatagaagtagtgttcacatccatttagagataccagcctaatgctacagcatcctctttgtgatcttgttgaaacagcatcagtgttaaaaacttgcaaatgaaaaccttcagctctaatagtctaatttttctgctttagtatcccccttggcatttgcctaactgtatatataccccacaatgtgctcctttcaggccttgacaattgcatttgcacgtgcattttagtgcaacagggaagcaagtagaagcaagctgacacagattattgaggctgctatagtgatctggcctgtcagaagtttcagaaatggatggatggaaaagtagttctttggcgttggggtgtctttctgtttggagtgtcagttgtatgttgcatggcccctctaactgtactgctcactcgacatcccattcggccgcctccaccacattccccatatctgagcatcagcagatgttgaccttttacacatcaaatcaggaaatttctgttttgttttgttttgttttgttttgaaatcagtggtgacctgaaaggatgcttcgttgtgcctttgaaaaaaatatattaacctttattatcgagaacctaggaaaatttactcctaataaaaaccctctgactaaaagtgatattttggactctcccttcaatatgcctctggctgttccgcttagaatgcaatgggtattttctcagatttccagcaaacaggatgtaagagcttccagaggtcacccaacatcacacatgactagcttacctgtttcctggcttttaaggtaaagagttacagtaaaaccatcaaacgtgattgtatcttctaggctgctttaatggcattcgaaagttccttctttgtgggcttataagttgctttttgcgtgcactcgtggattcctttcccctccaaagggcaagaattcacacgtagacgacactgccggttccagagggcacgggaatggggttttcaaggtgcaagccagagaaaaggaagctgtttggatatttagctaagttatgggtgtttgccagtgctttttgcattaccccaaagaaggaatcaatgactataattccactaactatatagaaagataccattatagcagatgtaacacccctgagaccccgattatcacagcatagctcaaggaaaataaatgatgtatattatcgatgtagattattgatgtatataaccatcagtttacatacatattctgtatacacagtgattaaaggttttggagccctaataaatttcagtatagatctcaaaatgccaacgcctgtattaaggttcaaatgcatggatagggtggtcatcctttccgatcatctgctaaaaatgtttttgaaacaaatttcccattaaggtcattcgtacctgctgttgtctatctattaacaaataggtttcccataatcctaaggatacttgacttagaactcagtcattctgatctgctttggccatggctgaaaaaatgctggtgatattgtcagcaattaatgaatcccaaaataaatctgtagcctttg

SEQ ID NO: 15236 - DNA, 1744 bp, Homo sapiens
tgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtaagagaaaatctgtctgccttcaatgggaacgggtgtgtccaaagaaaatgccagagtgtctcacagctgtaaagtgacatttgtcaatttctactgcaacgttttcttcaggaactccactgtagaagtaggttctgaaggcattctgagatccctcatcctcagcagtaatttgtaatcccaaacttgctgtccctgaacctggcatgattcttcagaatttaaataaaagtgaattttaaaaagtaactc

SEQ ID NO: 15237 - DNA, 1763 bp, Homo sapiens
tcggcccgccgaggcggaccaggctggctgcgcagggccgccgccccgcgccgtcggctcggctcccgcccggcgcaagggcaaacgagccacacgggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtaagagaaaatctgtctgccttcaatgggaacgggtgtgtccaaagaaaatgccagagtgtctcacagctgtaaagtgacatttgtcaatttctactgcaacgttttcttcaggaactccactgtagaagtaggttctgaaggcattctgagatccctcatcctcagcagtaatttgtaatcccaaacttgctgtccctgaacctggcatgattcttcagaatttaaataaaagtgaattttaaaaagtaactc

SEQ ID NO: 15238 - DNA, 337 bp, Homo sapiens
gatctcctgggcgcaagtggtgacttcaagctgggagacaaactatctttgtttagcaaggacagagaagttaaccagttgcatgactttcagtaaaaaaaatgagagagtcctggacaaaccaagacagttggttgacctgtgagtggtttcagtgtgcaagaacacactggcagttttgacattttgagatgtggtggctctcctagataataaactgtcttccacttctgtgtaagcttttcttagggataactcaccctgcttcagcaaatccgggcgattgtctctatcagccaaattctgcacatgtagcctctgaatctaaaataaaaat

SEQ ID NO: 15239 - DNA, 459 bp, Homo sapiens
ataatttgccatgtaaaagaaagccagatggccttcaaaccttgacagaagtcatactccagtttatattttaggaaagtatatttttccctcccaaatacagaattttaagaaaatatttccagaatacctactgaaggtgaaactacttcatcgggaggtatttacgttctgccagacttaaagtctataactaaatgactgcaagttcctcattaaagagcacagagacaacatctataaatgtcaccaaggacacttagtaagattaagccctccttttttcaaagaaactgaggagagtctaaaaccaccttggtacatgttcccttaattttctatttaatttctttaaggtaatttatcttatttctctgtcttttgaagacaagctaatgaaaaacaatgtccttttatccaacaagaggtattaaaaaccaaaattctggacaaaaaaaa

SEQ ID NO: 15240 - DNA, 328 bp, Homo sapiens
gaaattctactcattttcagatcaaactagaagtaagctttagtctgtcagtcttcaaagcatatacgacttggatttactttggataattggctaggaaaagcatgtcactgaagattgtgaaatcttataaaatgaattaaaacctcatttattcattcaacaaatttttatcatccatttgccgtgctatgtgccagatactattttaggtgctagagatacgggagtggataaatcagataaaaattctgtttcttctagggcaggggtcaaaaatactcagatagcaaatatttcaggctttgggggccaagtagttacgctg

SEQ ID NO: 15241 - DNA, 446 bp, Homo sapiens
ttccaaaaagccaggcacatgtgactatgaaaagggaactggaagagggagtctctggagaggcctgtggaaactgctgcctccgagtggaccagtggcaggctgctgttggtcagcagggccaacagttgggaaaacaagctgagcacagagcaccagagagagaacagctgggacctgctgggcaggtctgtgtctgttaccaagtctggccaggtccaagaataatgacttcttcacttccaaatcttgtacaagtttctcttttggttgactctacctcagaaccatccagagaaggagatttctgtgaaatacaggtgctagccgtaaccaaactgacatttcaatctagcatcattaatataaacaaagttagagtgggaaaagatatttccagtgcatgtaattgataaataattaatatccaaaaagcactacaaatc

SEQ ID NO: 15242 - DNA, 413 bp, Homo sapiens
cataaatgtaccattatttaaaatttaaagactgcttcttgatttatatcagcagtttccatcttattaaacatatgacatttaaaattctattgaaaatagtaagaaaaaagggtacaaaataaaaggaaagaaaagggtgtggctgagaaaattaaaactggcacaaggagcaagtccagggttctggtcccagctctaaggttaactccataacactggaaaaaacatgtcatctgtccaaagagcccaggccctcacacacaggggtagaatcactgtgtagttaagacctcttcaaaatatatacaccactctctccctcccccatctcccaagaattgtcctgggagcctgttttttgccagaatgtaacctaacctgctcaagtatgctggggcacgaaaaaaaaa

SEQ ID NO: 15243 - DNA, 777 bp, Homo sapiens
gttagaaagttctgtagtcagaaaaactgagtttgcttttagctttaaataaaatacatctatagtgatgcctcttcaactggagttttcatcattttgcgcaggagttcatggcactttattggcaacaagcaatgtttttttcttgaccttggcagaggagctctcaaggcagtgtcatctgttggccacgtgcatctgaacttctaaagagagtggctcaaatgcaggttccaaggccctaccccagtcagaatctctggaggtggaacccagactccacatttgtaaagagaacctccaagtgattttgatggaatcttcagtttgagaaccactgatcaagggaatagatttgtgccaaattgcaaatcaatgtagagacccagctagaatcccttcagcctcctccacaacctggcccacttcttggtcctcacatcaaaacaatctcttcctttcttcagtctttcatggactttcagttctccagtatgctcaggggctccctctccaagaagaagtcttcaatctgcaaaccccacctggtgcccctttacctgaagaacatagaagagtcccacatccactgcctccactgcccccattcatgcctcagcacctccatccctccttctcccaccccagcctcagagcgaggttccagaagtgtcaccaggggccacacagtggtatcctccttgacctcctgtagcacctagcagtgctcccaactcccttcctttacagggtcatcctcatccagaggaggtgggg

SEQ ID NO: 15244 - DNA, 517 bp, Homo sapiens
atgatgctgtgagacaatctaagaagaattaaaatttaaattcatgtattcctacttttttctctgttctctaactgtaatatattttaattacagatggaggaacagacagatgttagataaatagatatataatatatagatcatccaaaattcttattcttatggttttatgtagtcagtatttacctctatttttctacatgtttatccttccaatttagttcattatttcctgcacctttgatttcatatatataaacaggaaataacacatggtggccgttatgtagagagagccacaggacttgtgaataaaatccacaggcaaggacgtggcgattccttttgcaatattggagggaatgccaaaccctatgtttgctgtggaaaagagtatggtagttcctcaaaacatcaaaatggtattgccttacgattcagcagccccacatctcaagacagcaaaagaattgaaagcagagtcttgaaaaaatatttgcacatccatgtttgc

SEQ ID NO: 15245 - DNA, 443 bp, Homo sapiens
aagcagtattcatgttaaaaagcaatgagggactccttccctggtgcacaattttcttcacttgtgatctctaaactgttttcaaattggaagactgggaagcattgctacagccccagccagtctcagccactgctcagcccagtggtggaaagctgagcacacagcgggtgcttactgcccccacttgccgtctgctctccagtagatcaagggacctcagacagggatctgagaagtggcaggttccaataaactgatcaacagaatgaagtcactctgggaagccatgaggtgactttacagcccaagcatgtaaatatacacacagaggataatatatattctttttttttttttttttgagacagagtctcactctgtcagcccaagctggactgcagtggcgcaatcacagcccattgcaacctccacctcctggg

SEQ ID NO: 15246 - DNA, 234 bp, Homo sapiens
agtgagaggatagggtttttggctggggacagtaagaccatcatcactgcgtgaaaaccttctcaaagagtccatctttcagtcaggccgctataaatttatctctatagatcattcgttgttaaaattaagcccagggggaaaatcagactcattcaggatcaaggaaagtcacagaatctgatccattcctaccagggtcccacgtcggcccccccaagagcgacggacagg

SEQ ID NO: 15247 - DNA, 394 bp, Homo sapiens
gtgagggtagtaggtcgggtgagagtgggttcacatagtcttttaggaacctgatgaaagctgtggcagtctactatccagagcttaacacaaaattctgcatatagttttgggggcatatgagttcactgatgccaggtcaaaccccttgctttatagatataaattcactttaggatgcaaatgtaaagcagtggttttccatcaggcgtgcgcacacacacatacaccccttctgaattggaatttacatgtgtactggagtccttagatgactctgatatgtattttggattcagagccactgtataaagaaatggttaggaagaaaagatacttggttagtataaaagtgttacatacaatcacgtcctcccacgtgagtccttactac

SEQ ID NO: 15248 - DNA, 312 bp, Homo sapiens
atttgtatttccctgctgattagtgatgttgaatatcttcatatacctgttgcccatttgtatttcttaggttgctttttcactctgttgattattttctttcccatgcagatgctttttagtttgatgtcctcccatttgcctatttttatttttgtcatgtaaatttttatattaatgatttatattaattatataacactatatatatagtgtttgaagtgattgggttgatatctccagaatattattttgtgtctattatatatcataccacataactaaagtagatatttgtttcattttattttt

SEQ ID NO: 15249 - DNA, 728 bp, Homo sapiens
gaatatgtccaccaaagacacctcgttggtcatgttctatcacctcttcgtcaaattgacatcaggtcctaacaggtcactttcaagatacagaagaggcaaattttgttttgagacttggccattcctagggtcagcaaagtgtattcctggcagccagaccttcagtcacttatcaggaaatgcttgacctaaagacagacaattctttccccaaactttgctgtttcttttttgagtctttgttgaaagatttcttttaaaaggcgttcgtgtgagaagatcacagcaacaaatctggcttgttctgttttagacttactttcttaactcttgggcagaagaaaatgaatgagatttgaagacctttgataccttgagtagacaaagcttgccttgaaactagaaataagacgaaactagattttaaggggaaaaaatttgctagtggtaatataattggttttgtttcatttttttatgagtctgaggagttgacattaaacgttgggatgttgctttgttaatgaagtcatttcaatttttgcaactcttaacatctgcatgcttccataaacagtgggttggaacaaaagaaaatgtgactaagggatattccttaaattcttttttatgttatgagagagaatattggaatataaagaatgttactttatctggtaaaccatctcataggccagaagcactaacagtttgaatggttggct

SEQ ID NO: 15250 - DNA, 402 bp, Homo sapiens
gccgcttggtgacactgcagccgcggctcagcactgtcacccagaaaggcccgccgacgtctgtatgcagggaacgtggctcttagcagagcctggacaggcgcagggccaaggaagtctttgtttttgtttctttctctagcccttcctgccaatacatcagggatataactccttggtgtttctgccttacaatcgctccttataccccacccagatcctcagcactgcagctcccactgccactgcccgctgtgagtcacctccccctctcccttttttaaaccaaacggcaaggccatattgcagttatccataaatggaaaagcaagaagccaccaatacctgtttgagaagatggcattttaattagcacactccggctgccataaacccgggctc

SEQ ID NO: 15251 - DNA, 491 bp, Homo sapiens
atagaattacagatgaggcaaacgtagaatctggaaatctctggttgatttggttaaccttctgctgtgataatattgatacttaccacatctctctcacacacacacactcccacatagaaatatattcctaattttgatgtatgagcattttagcagtgactccattcctgaagtttactgcagctcacaaatcactaatggtatttgggcaaacagaaaaggacccttgggacacagcaacacagtttttgcctttagctgggtgaactgatggctacctgtcccataaccatgggtgtctccactcctagagtgactcctgctacgcacccactcctgacctccctccctgcctcccagcaggccacagcacatctgtggatggccaagagcaagaccttctgggtctgggtggggaggctgggttcttgagggcctagggtagtaggtagtaagggccagttgggtttgccctgtgcctgcctaat

SEQ ID NO: 15252 - DNA, 393 bp, Homo sapiens
cttttcttccacatgaatgtgaaattctggaagtcaagaaccatgtttgttcacatttttatctctagtacacagtacagtgcctggtataagaaaaactcaatgtattttaccatcctaacatattaagtagagctctacggcagataaatgttaactctcatgatcatatcactaagaagatgtggctgtaacagcctgtcgttgctctgaaaataaagagccaaattctcaccgctgctgcaaaggcctgcctgatgggtgcccttccttcctgtctacattctcgctttgcccatccctcctcccttctcagcctggttaccacctacccttccttcaaaacctgttgaagcctcacttccccttggatgcttccctgccacccttgaa

SEQ ID NO: 15253 - DNA, 368 bp, Homo sapiens
atggataccggggggccatgatggtgtcccgaggcggggtgtgccaaggtggcagtgctctccctgcccagctcctgctcctcccctccccagtcctcacataccagctgcagagcatttgacaccaggcatccacaagacacagaccctgctcctcagaatcttgggctcatcgtggaaatcaaggaacaatacaggggaagacagaatatgagtctcagaaagttgtctattttgtcccttttaaaaacaagatttctcatacctgcagtcctagtactttgggaggctgaggctggtggatctcagagcccaggagttccagataccagcctgggcaacatggtgagtgagaccccgtcttcaca

SEQ ID NO: 15254 - DNA, 680 bp, Homo sapiens
ctcttcctctcaccttcatggatctagatatgtcaccgtgagattccctatgcagaggcccatgtggcaacaaactgatgtgtccttccaacaaccaggcctgagacctcacaagacccaactggatctcccagacagagcaggcagaacaccatttctgctgccccacagccctcaaagttgttactccccgactctggaaggttctcagtgactagagactggtgcggacccccagcacagtgtagccacccccatgaaaacgtgggaaccctcaagagacaactgaaaaaatctctctcacaaccatcatcaagatcccattccctgctgcctccaagctggggagagaacataaagcttgagctcgcctcagaccagtggtatacagctcaggacagccaagcatgcatttgtatgtgagtgccagtgcgggtcatcacagcttgcatccatttcaagtcttcatctaacatacagaaggtcttcagattgagaggagcagaacatgaggtactgaactcaagaggtctcacgtgcacttggacctgatttacatgacaaggttctggcctgattcagtaacatgatacaatcttatgtggggtattgggaggttgagtatgtatttttcatggggaagaatgtaaataatccatggaataaaaaatatgactttt

SEQ ID NO: 15255 - DNA, 351 bp, Homo sapiens
aagtgagaacgttcagtatttgacttttggttcctgaattaaatgtatttctttaattcacaggtcttcagattgagaggagcagaacatgaggtactgaactcaagaggtctcacgtgcacttggacctgatttacatgacaagttctcccccattggcatgctgataaatgagagtctgaagctttgacataaaaacctaaactctacctgtgtacagaacagaaacagaatgagagcgaaaaaacaactatactgaaagcaaattgaagagaattgtgaactttcttctgaatgcatatattttgctcgacaagtttagcttccataaaaatctgaaatctagaatgt

SEQ ID NO: 15256 - DNA, 681 bp, Homo sapiens
ctcttcctctcaccttcatggatctagatatgtcaccgtgagattccctatgcagaggcccatgtggcaacaaactgatgtgtccttccaacaaccaggcctgagacctcacaagacccaactggatctcccagacagagcaggcagaacaccatttctgctgccccacagccctcaaagttgttactccccgactctggaaggttctcagtgactagagactggtgcggacccccagcacagtgtagccacccccatgaaaacgtgggaaccctcaagagacaactgaaaaaatctctctcacaaccatcatcaagatcccattccctgctgcctccaagctggggagagaacataaagcttgagctcgcctcagaccagtggtatacagctcaggacagccaaggtgagatctgcaaccaacactcaagtggaagaggagcacacactttcagaccactgagggggtgcatgactgcaatcatgagcaaaatacagatgagcatgtggctgaagaagagtctacctactggccattatatttaagcaccatctactgcatcacagtgtaacatcaacagcaaaaatactttgttaatataccccctggggaactaaggacaataatttaactacaaataaagaccctacctaaagccttagccctctgaaaatatccag

SEQ ID NO: 15257 - DNA, 450 bp, Homo sapiens
aacctttatgaacctgtgtgaacctgtgtgaacctgcatgaacctgcgtgaacctgtgtgaacctgtgtgaagtgcttcagagatacccataggcatttgttttcctctgtgggaagatttcaggcctgcagctgttaatgttgggttgccgggtcctttgagttctctgtcccttctggtgtcacagttgcctagcagttgctggtttgcctggctccactacatgccctgggtggggatgtcctgttcatcccttggtgccaagcactgagcactgagcctttgtggcctctgtgctcactccagaggggccagccttcctagccctgctcagctggtgtgtgtctgtacattataagtaagaaactggctgggcgctgcctgtaatcccagcactgtgggaagttgaggtgggcagatcacatgagtttgggtgttcgagaccagcc

SEQ ID NO: 15258 - DNA, 132 bp, Homo sapiens
ttgagtgtttattacatattctggataaaaccttttgtaagatatatgacctgcaaatattttcttcccatttgtagcttgtcctttcattcccttaaccatttttgataaagcaaacgttttaaattttga

SEQ ID NO: 15259 - DNA, 776 bp, Homo sapiens
aacagaaatgagggaagggtgtaggaagtagaatatttactaagtggaagaagaatacaataatttctttaattttggttgattttaactaggaagaaaagactttggaaaccatcctttagaaaggcaggctttagtcttaaatcccacaaactagtaaaagaagctttagaagaacaaaatataagcttaagttataaacattgagaaaactttctttttaccctatttataatatcaggacaatattaaaatataatgtttaaacaatagatagctaagaatactccagatgtcaagtacctgggtgacccccttggtctgctggcctcctggacttagcctgtcccaagatatttgaataaaaggggccctgtcccctatcaagggaagagggaaaccagcctgcctcttgcctccccacacatatgtatccagagagtctcagctctagttggctgttgcctattctggttgttacatatttttgttttgttttgtttttgagacatcgagtctcactctgttgtccaggttggagtgcagcggcgcgatctcagctcactgcagcctctgcttcccgggttcaaacgattcccctgcctcagcctccctagtagctgggattgcaggtgtggtgacattcgcctgtagtcccagggaggctgaggtgggaggatcacttgagcctgggaggtcgaggctgcagtgagataggattgtgccactgcactccagcctgggtgacagagtgagaccgtctcaaaaaaaaaaaa

SEQ ID NO: 15260 - DNA, 157 bp, Homo sapiens
tacctatcagaattttttttcttcagtttttattaaatggctggctggttgtcacatcgtttactgaataattccatcgtgttccaaaaaccataaaatgctgtctttatcttagactaaatatctattaataattgggtatgtttctggactttga

SEQ ID NO: 15261 - DNA, 513 bp, Homo sapiens
gtccacaattcttaagtgtctaaggagcacctactgtgataggcacctcctgtgataggcactcttctaggtgttgggaatacctcactgaacaaaacaaactgcttatggagcgcttctatttggggatataatatactatacttatatgtggggatataaacaaatgtgtgtgtcaggtgttaagtgtcttggaaaaaaaagtagttggtaaaaagatgaataaaagaatgggaggaggcaagttgctattttgctatttgtagctaggatggtcagggaagatctatttgataaaatggcatttaaacaaagaaacctgcaagaagtgagagagtgaaccataaggaagagtgttttaggcaaagaacagcagatacaaaaaccttgtggtggctgggtgtggtggctcacagctgtaatcctaggactttggatggctgaggagggaggattgcttgaggccaggagttcaaaaccagccttggcaacatagtgagacttttctacaaa

SEQ ID NO: 15262 - DNA, 596 bp, Homo sapiens
atatcatgtcttctttggccttttcactgagggcctgtgccattctcgatgcaaataatcttttctgaatatgggagaattactaacaaatttatacctgctcaccaggacgctatacatacttgcacatgtaattttgcttatagcttcagaagattcgtgggcccttccttcgccaaccatttcatgaacccatgagccccagattaagaactctttctcttggttgttgttaaaatataactacgtagcaggaagaggaccattgtgatccactaccaatagaacatttatagttgaaaatgcaatttgagttgtttgttcaccagtgatgctatgttatgcatttgtttacatctcataacatgtggtaaatatttatgcaagatggctagccagacaaaaagaaaaaaaaaaaggaaaaacaaccgtgaaatagagaatgcagggtgacccatgtaaacaggctagagatacatttgaaaaagatgagggttaaagagtgtgtagatgttggcaggtaaagagatagcatcctctagggaggatattatcaggagtcagagtaatcttggtaaatgggagaatatgtaaga

SEQ ID NO: 15263 - DNA, 300 bp, Homo sapiens
tatagttgtccttgcagtattgtacagtgtctctgaggccaatttttcctttgtaagtagtaagcataacttggaaattaggttctcagaaacagtgttcaaccataagtaaccactgaagacacctgtctgtgccgtcatctctctgtagttaattgggtctcctaactacagccctgtagttagttaggcttgtagttcagctataggcttgtgctgtagcttgttttgatcacatatagcaattatttatttatatatttcaaaacattgctcaattcacctatccagggattcctt

SEQ ID NO: 15264 - DNA, 315 bp, Homo sapiens
gtattgctcacacatttaaaaaatcagaagacaaggcagacactttactactgttaatatgagaatcaaacatacaaataatttgtgaagcataaatagaggtaaaaaagagagataatggctaattcctggtaaacctaacaagggcaggaaccatgtctgtttaatccaataatgtatacctagcacttagctgagtgttggctagcaaatgtttaacaaatatttttgaaaaaaatgtaagaattcctggatgtaaacatttacttttccgaaacctagtgaaaagcattaaatgttattggtgtttaaagt

SEQ ID NO: 15265 - DNA, 903 bp, Homo sapiens
tatgcgaaaaccttctaatgttttcttcttgttaaacaggtaatatatgcacattgtacaaaaatcagaaagttgaaaaaggtggggaaaagaagtccttctctcactcatttcccttccctgaatccaaactctgttaccagttatctttctagaaatggccccatgcacatataaacatatatgaaacacaaattatagcataacatacagacttttgcacattcagcaatttattctgtagccttacctagaattgtcccatttttttcaccaattgcatagaactccattatatggatgtattttgattttttcaaagaatcagttctgttactgcacgttgttggttttcagtcttgctaatacagacaaggctgaaattaagacagtaatcaagaatttgccaagacttccttccctcctcccaaaatgcctccactccaggttccaggtctagatccttgggattttctaggtgatggaagtatctttgttattcatagtgagctctgatagttacgctaaccagatgactcaaataggggctagccacaccagaagaccaaccattggattagagggttggagttttgagtcatatgatattagcccaacctctgaggtggagagaggggttagagatggagttcagctttatatagagattgagtcaattaatcatgcctgtcatgaaaccccgagagaaactctggtcagtgatgctcaagtgaacttccctggttggcaatactctggtgtgttctaggagggtgacatgtccctgagggcacagaaactttgtgtttgggatcctcttacaccttgctctatgtatgtcttcttttggctgttctgatttgtatccttttgctataataaactgtaatagtacgcatagca

SEQ ID NO: 15266 - DNA, 2449 bp, Homo sapiens
tatgcgaaaaccttctaatgttttcttcttgttaaacaggtaatatatgcacattgtacaaaaatcagaaagttgaaaaaggtggggaaaagaagtccttctctcactcatttcccttccctgaatccaaactctgttaccagttatctttctagaaatggccccatgcacatataaacatatatgaaacacaaattatagcataacatacagacttttgcacattcagcaatttattctgtagccttacctagaattgtcccatttttttcaccaattgcatagaactccattatatggatgtattttgattttttcaaagaatcagttctgttactgcacgttgttggttttcagtcttgctaatacagacaaggctgaaattaagacagtaatcaagaatttgccaagacttccttccctcctcccaaaatgcctccactccaggttccaggtctagatccttgggattttctaggtgatggaagtatctttgttattcatagtgagctctgatagttacgctaaccagatgactcaaataggggctagccacaccagaagaccaaccattggattagagggttggagttttgagtcatatgatattagcccaacctctgaggtggagagaggggttagagatggagttcagctttatatagagattgagtcaattaatcatgcctgtcatgaaaccccgagagaaactctggtcagtgatgctcaagtgaacttccctggttggcaatactctggtgtgttctaggagggtgacatgtccctgagggcacagaaactttgtgtttgggatcctcttacaccttgctctatgtatgtcttcttttggctgttctgatttgtatccttttgctataataaactgtaatagtacgcatagcactttgctgagttctgtgagttgttctatttaattatagaacctgaaggtattgtggggacccctgaacttgcagccagttggtcagaagtaaggatggtcctgggaatgcccaaagttgctagtttctgaagtgagggcagtcatatggaggactgggcccttaatctgtgaagtttggcttaacttcaggcagttggtgtcagaagccattgcaaatatcctgatgatccgtgcaaaacaaaaacacttaacagaaaattacgttgtactctctgtacggataattttcggttaagtgtttttgttttccatggattgtactagatatcaatctgataaataacttttattcattatagttttaatttgcatttctcttattaatttttgttttaaaaccattttctttccagttctacgatctgttaacatatttttcccacttttctattgggttggttgtctttttcttattgatttgttaaaactctttataacagaaattggtcatttgtgatatgagtctgaactgtgtttctcaatttgtgatttttctctttacttttttaatggtgtctttttcttgtagtttttttaatgcaggtggaattatcagtctttcatttttttcttctgtgttctacctgtttcacaggtagaaaagccttagctctttgagattatgtttaaatgccctgtattttcatctagtggttttatggttttattttgtatgtttttttcatccacctggaatttattttgctgttaaaatatgaattagagatccaacttaatttttttcagatggttgttgacttattgcaatatcatgtgttatataatccatctttactgattcgttgctaattggtttctggacttttaaggctatctgatgaactgttgatctggtaccacactgtttcaattattgtagtcttaaaattgctgtacgctttggtagggataattttctgttaagtgtttttgttttttataattttccaattagtcttgctcattttttatataaactttgaaatcaatttttctgattttcaaaagaaaaaaaatcctgtttagtattcttagtggaatgaattaaatttccatagcaatttagggaaatttgactttcttaacgtgttgagtgttaaacccacaggtggtagcatgacattgactcctcagccaagcatattatcaactgtcggaaactaggttttcccatagtgatccaagaaactagtacgaaatgcctttctgattttttaaaacttgtatacatatatagtacatattatatatacttatatattaagtaatcagaagtatgtgtttctcaatcaccttttaaagacttctttatatagctcttgtacatttcttgatatgaatatgttaatgttttctttcattatgttgcatatggcttttgttttctgcatgaaaactattgatttctgcattctaattttgttcccagtcacctaactgaattcttctaacagttgtaataaatttctggttggctctcttgtg

SEQ ID NO: 15267 - DNA, 484 bp, Homo sapiens
tacaataacaataccaaaatacctaggtagtggcatgatcatccattaaagtattgccccaaattcctaacaattagattaacttttcaactcttaagtaaattcacattccatctctattgcatttagccaagaaactgatctttgttatgggaacatttttctatgtaaaagttttacaaataatgtaaatggaaaattgtagccaggtgcagtgggtcatgcttgtaatcccagcagtttggcagactgagttaggaggattgcttgagcccaggagtttgagaccaacctgggcaacatggcgaaacaccatttctacaaaaaatacaaaaattagccaggcttggtggtacactcctgtaatcccagctacttgggaagctgaagtaggaggatcaattgagcccaggaggtggaggctgcagtgagccatgatcatgccactgcactctgcctggatgacagagtgagaccctgtctc

SEQ ID NO: 15268 - DNA, 511 bp, Homo sapiens
tacaataacaataccaaaatacctaggtagtggcatgatcatccattaaagtattgccccaaattcctaacaattagattaacttttcaactcttaagtaaattcacattccatctctattgcatttagccaagaaactgatctttgttatgggaacatttttctatgtaaaagttttacaaataatgtaaatggaaaattgtagccaggtgcagtgggtcatgcttgtaatcccagcagtttggcagactgagttaggaggattgcttgagcccaggagtttgagaccaacctgggcaacatggcgaaacaccatttctacaaaaaatacaaaaattagccaggcttggtggtacactcctgtaatccaggcagagtgcagtggcatgatcatggctcactgcagcctccacctcctgggctcaattgatcctcctacttcagctacccaagtagctgggattacaggagtggttcgcacggccgcgaatttagtagtagtaggggcagc

SEQ ID NO: 15269 - DNA, 222 bp, Homo sapiens
cactggccagattttccttacctccccttccactgaccatccttgtttctttcaactagtgagttctgtgctagcttcaggctctaggcatgcccttctcttctgtccataccaaggaattgtggatggaaagtgacctggtgataaaaacccatcttccttaaagtaccctccctgcttccaaacccccagcttttttcaactcaaacaatgcccagattt

SEQ ID NO: 15270 - DNA, 470 bp, Homo sapiens
attacagatttcagtcacattttgtcagtactgactcttgctgcttgtgttctgttgatatgggtctccaattatatcctgtcagcagatgctttttcatttaatgattggtaatgtagaagggggtaaaatactattaattttatttttgtgccaggtgcagtggctcactcctgtaatcctaacactttgggaggctgaggcgggtgggtcacttgaactcaggagtttaagaccagcctgggcaacatgacaacatgacaaaaccctgtctctataaaaaatacaaaaattagcttggcgttgtggcatgcgcctgtagtcccagctacttgggatgctgaatcgggaggattgcttgagccagggaggttgaggctgcagtgagccatgtttgcaccactgcagtccagcctggactgcaagtagacgccggcgcgaatttagtagtagtagtagttgacccggca

SEQ ID NO: 15271 - DNA, 359 bp, Homo sapiens
taaacgtctacttttctcctaatgttgtgtctcctttgctggggaaaacttttataattgctgcctaactcctgttgtttcactctgtctgccctctctcctaccctgcttttacccccagcctggagtccacttgggtggaaatgcagcatataatgagcccaaagttaatcatctgcaggtttgccctgataagtcacagtatgtttgctgcactccttccaagagtcaacagcagctttggggatgtgctgagagtggcttatggcattctgagcgctggcccagatgggaggcagtgtgttggggagtctatctgaacgccaccatctggaatgcctctgttgccctgaaggcac

SEQ ID NO: 15272 - DNA, 571 bp, Homo sapiens
ctcaagccatcctcccacctcagtcttatgagtagctggggctacaggcatgtgccaccatgcctggctaattgtttttggtagagatggggtgtcgccatgttgcccgggctggtctcaaacttgtgagctgaagcaatccgcctgtcttggtctcccaaagtgctgggattataggcatgagccactgcgtctggcctgttagccatttttattttagcccttccagcagaggtaaagcagaatctcactgagatttaatttgcatttcccagatcactgatcatctattcatgtagttactggacattcctatatctttttttgttgaagaatctattcacattttttgcccattaaaaaaaaattggattgctctcttcttcctgagttgtagaagttctttatatggaccacaaacaaatcctttgttagatatgcgcgttgaatattttctcgcattttgtgatttgtctttttttttgagatggagtcttgctcactctgtcgcccaagctagagtgcagtggtgccatcttggctcactgcaacctccacctcctgggttcaa

SEQ ID NO: 15273 - DNA, 386 bp, Homo sapiens
gtattcatatattcacaggtctacctttcacttgctgaaaaggaaaatggtgactctatctgtgatgtattaattatatttatgtttcctagaaccacaaattcaggttcaattacacttggttaagtcttacatctttgttataaataatttatattttcaaaaatttcctggttagaagttttgcataacatttgaaagatgaacctctctctgtttcatccatgattaaaatgcagtggaaattttcagaaagtttgcattccatcttaatgttcgtgggtagagtttctggaatgctgctaaatatcttaagaagtatttcttacaacatatttaaccttgtacatttagaagaatttagcttagtggcagtattaaatatt

SEQ ID NO: 15274 - DNA, 371 bp, Homo sapiens
gagctgcacccccagccacagggcagcaccctggccccacgagcctgctgcaagcctcaggagagtgagctgcacagcagaccctgccagtgattcctggggcttctcagacctcaccaacacctgagggtcctgctcatcagacacgcacaccccacccccatccccagcccagactgactgactcagatcaccagggagagggcccagggtctacatttgtctaaagccccccaggtggttctgaagctccgccagcttctagaacaccaccatagcacacacagatgctgcctgtgacacgctgtgttttcggctgtcatctctgggataaggccccttcagggaccccgacagcatcggaagtgaga

SEQ ID NO: 15275 - DNA, 311 bp, Homo sapiens
gagatgaactctatgattgctctagcttagtgtttgcagagagattccagatcatagtgcagaggagaacccaggtagaacttgggagtcttgaggacattgcagttaacagtaccagagtatagagagttacactgatacagaacgctggagatttgtggagaagagacttagagtaaacagataagtactaatgactgcctgtgtgtgaggagagaatacttatgaacttcttcataagtccagtatttaccctgatacaagaatattacaagaaaagactattacaaaacaaatgtcattcacagatg

SEQ ID NO: 15276 - DNA, 375 bp, Homo sapiens
gcagaggctcctgtgtcccatccgcctggctgtgggaaccccagccttccccctccgcttcctcaagataaacccaacaccccgccagggaagaagctgctgctccagcacccccgccccacctggaacctccgggaagagagacttcttttacaaagcatgccacagtgacctgaaccgggaagaaaacaatggcttcttcagttccaggctgaggaagttcacatttgagtacctgacaacgaaatttcctatcaatacaagtaaagcccaaaagaaggctagctgggggccctacctcccttaacccttggaggtttggagagcagccaggccagactgctgcacgtggctccaaggcaccctatgtgataa

SEQ ID NO: 15277 - DNA, 381 bp, Homo sapiens
ctctagtggtcttttcttggtccaagaagagacaaacattctgcttctggccctggcagtgtggtagttgctgggggaggctggcaggaactgtagtggcaacaggattccgaccccccagcatgataggcagcatcttttcagctatttcagttctaatctaggtgcacaactctggcagagccagaaccaactggctcaacattagctcctacagtgccacctctaccctgggggtattagcagctcctgatctcagattatcacaccatcttcctttttttcccagggcccctaaacctttttccttttgctctcccaacacttctaagaccattctaatcggttacctatattgaatttttctctgtttgaaatact

SEQ ID NO: 15278 - DNA, 289 bp, Homo sapiens
taagaggctaaaattcattcagttaggatatactatgcactagccattatttaaatattagctcatttgattattttgacaacccttatggggataattatcttcatcatggagataaagaaactcaggatcaggctttttgaatactctgctcaataccacaagtcctctatgtgacaaaggtagaattcaaactcagatttattgaattattcagcttaggatttcctcactgttacaccttacagctctatacttcctaagtgtcctgagagggcaattaacctaa

SEQ ID NO: 15279 - DNA, 212 bp, Homo sapiens
atattttaggcatttatcagcaaatttatagctactcattgctagaggtgtttatgggcaaaaaaaagagaaaagaaaaatccttaattatcttaagagaattaaatattgatgcccttttttaagagcactcatagaatgttgacactgacttgagctctttaagtgtttataaaacactgacctggattctaaattttgctttatactta

SEQ ID NO: 15280 - DNA, 283 bp, Homo sapiens
aggcactatcccatttataccaataaccagtgtatatctacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatcca

SEQ ID NO: 15281 - DNA, 847 bp, Homo sapiens
gctggccccatccagaacccggttctgattagagggcaagagtgacagacgtggagggtggaggggcccagagctggaaattgaaccatcatcctgctgcttgcagtcctgagccttctcctgctgaatgtcaggtttgtttaaaacagcaagagaggccttgactgagttggatgcccctgctcccattcagatggtccccacaacaaaggaacggaatggcagtggaggagaccagtgtggtttagagatgcaaatcatcacgcgttatggagaaagcagacacctttcaatggcaggagatatggaaaaacctagtcatgttgacctctttttcagatgtatctcagattctggaattatagcataataggaattccttccaaatccacaaagcaatggttcctatccctgccttgcaaaggcttaatgactctagcagcagtaagactaggagcaaacagtaaaatatcatctcctatctctcagttttgtcttgcactgtattacaaagagtatcatgggcaaagatttaaaatgggcagaaatgctaagtattcattttaaatatacatgggctcagtgcttgcctcgctcagaacctaaaaggggtttatacagattcttaatatctaggaattgatgcatggttgagtcacggatgaatctccttctctccctagccataaaaatgctacctaacttgactctgacttctgtaataatattcctaactagagaaaaagtcaaacttaggcatcatctgacttaggtacatgtcccaacttgagtgcttactcattctgtgacttgtccttcaacctcagaagagccattgggccccttg

SEQ ID NO: 15282 - DNA, 477 bp, Homo sapiens
atgatgctgtgagacaatctaagaagaattaaaatttaaattcatgtattcctacttttttctctgttctctaactgtaatgtattttaattacagatggaggaacagatagatgttagataaatagatatataatagatagatcatccaaaattcttattcttatggttttatgtagtcagtatttacctctatttttctacatgtttatccttccaatttagttcattacttcctgcacctttgatgtcatatatataaacaggaaacaacacatggtggccgggatgtagagagggccacaggaattgtgaataaaatccacaggcaaggatgtggcgattcattttgcaatattggagggaatgccaaaccctatgtttgctgtggaaaagagtatggtagttcctcaaaacatcaaaatggtattgccttatgattcggcagccccacatctcaagatagcaaaagaattca

SEQ ID NO: 15283 - DNA, 493 bp, Homo sapiens
gggtgctcagtgtggcctcggtcaacacactacctggcctccagctctccaaagccattttaggctgaaggtggtcagtgaatcacatctgagggcgcaggggccttggccctcctggctaacagagttccttaggagcgcagaaccccaaacggaaccgccttggaaagtccacccagtcactgcggggtctgggtgggggtggaggtgcaaggtccccagatattctcggagattttcacaccatctcagcaccacattcagaactcagcctgcgccggttgcagcaggaagaaagaattatgacttgtgactttggaaagcgagaagctgcccagattccccctccctgagacatttggggtgggaagttcagggagaattttcaactgcaagaccaaggtgatttagaaggtaaaacatttgcgtttgtgtcaaatttccacaccttccccctccggatcccaccgcccctgcttcccacacagcatgg

SEQ ID NO: 15284 - DNA, 338 bp, Homo sapiens
caagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtctt

SEQ ID NO: 15285 - DNA, 781 bp, Homo sapiens
gaactgttgtcctttattcacttcctaattatagaagtgtcctgccatgtagtaagtactcagtaaatgttagcatggtagcagataaagtagaaaatctcttttcccccatgaccctccttgtgaagaggtttctaaaagccagtggtcccttctccctgagtaaagagggtgtggtaacttccagaaacgtttcttgccctttgaggatatgtggcactgagtagtcaccacacaagctcatcccccggtgcggagatatggctacttcaggaattgggaggaccccgcgctgcgcccggaatgtgctctggcaatggtttgcctttcttttctgtcatttcctttatttttgtgtgttttccattcatctcttgttcctcaaagctgcacacagccccgcccttctgcttggccaaggtctggttagcaaagggccctgtctccggcggatctggctttcctcgctgtcagccttcaggtgccctgaaagctggcgaaggtttctgagtcaatgctggggttgagtgggagtttagaacatcactgcggtgccgcagtcactcttggacgtccacgtcctcttggaggtttgaggcaggctcagctcagccgttcgctttggtatcctcataatcaggtagaaagtctggccggggccaggggcagtggtgcacacctgtaatcccagcacttttgggaggtcgaggcaggaagattacttgagcttaggggttcaagaccagcttgggcaacatagtgagaccccatctctacaaaa

SEQ ID NO: 15286 - DNA, 768 bp, Homo sapiens
gaactgttgtcctttattcacttcctaattatagaagtgtcctgccatgtagtaagtactcagtaaatgttagcatggtagcagataaagtagaaaatctcttttcccccatgaccctccttgtgaagaggtttctagtttcttgccctttgaggatatgtggcactgagtagtcaccacacaagctcatcccccggtgcggagatatggctacttcaggaattgggaggaccccgcgctgcgcccggaatgtgctctggcaatggtttgcctttcttttctgtcatttcctttatttttgtgtgttttccattcatctcttgttcctcaaagctgcacacagccccgcccttctgcttggccaaggtctggttagcaaagggccctgtctccggcggatctggctttcctcgctgtcagccttcaggtgccctgaaagctggcgaaggtttctgagtcaatgctggggttgagtgggagtttagaacatcactgcggtgccgcagtcactcttggacgtccacgtcctcttggtcccttgccgctcgctcagttcacctcctcgctttccgatcctcctactctggcataaggtttgctccgctcccagcgacacgtctccacgcctcttatccacctcttctgttccgcattctctcgtaggtaccttgcctctaggtcctctacccgacctgcccaccatatgtgcctctctcgcttctaaacatctgctctttctccggctgggttccactccccatttccccg

SEQ ID NO: 15287 - DNA, 354 bp, Homo sapiens
accctggtccccttccgttggaatgaccacaccagtttcctgtatgtcctcaccgcacccaccctggagccccaagagcactttgtctgtttaccctcttaaaaattatcaaagacctcaaagagctttcatctgtgtgaagatgaactattctagatagacactgggcagagggttaactgatggtctaacatcaaaaaagaagacagtaaaactataaaatagggccttgaccaggtgcagtggctcacgcttataatcccagcactttggggaggctaaggtgggaggattgcttgagcccaggagttcaagaccagcctgggcaacataacaagactcttgtctctatta

SEQ ID NO: 15288 - DNA, 675 bp, Homo sapiens
agtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtg

SEQ ID NO: 15289 - DNA, 583 bp, Homo sapiens
ggaaagaaccatataggaaataagctggaaattgatttctcaaggcttcaacaaacaccaggtatggtctgactgctccctgttctttcttcttccccctctgaaacctcccggtttcttggttagcagcagccttgtcatttcccctttggaacattggtctctgtaggaagaaatcagttatccgttacggggaaaagactaagcagagcagattcactgtccgtgtctcctcctttggccctttggtttctattgatggatctggaagggtggcatcaacatttttttccatttctatttagatgtgtatgtgaataggctgagactacagttattcatctgagaaagtaacattcttacattcaggttttcagtttcagcaagctgcaaaatgattgttcataaaatattgaaaaacaacatgtaatacaaatattagccaggtgtggtggtgcacccacctgtagtcccagctactcaggaggctgaggtgggaggatcacctcagcccagggaggtcaaaggtgcagtgggctgtacttgtgccaccgcactccagcctgggcaacagagtgagacc

SEQ ID NO: 15290 - DNA, 462 bp, Homo sapiens
ccatctgttgggaaattaccataatatacagattttaaagaataggatacttcatggccacctgccggaagagtcttataatattcaatcctccagtctatgatatctgctatgcatgtggtccctcctaatatgtgggcactcttaagtatatagcatctgcacaccctgcctctaagtttcaggacaggaaaagggtgggttacagaaattatagaataaggccaggcgtggtggaggccgaggcaggtggatctcctgaagtcaggagttcgagaccagcctggccaacatcatggtgaaaacctgtctctactaaaaatacaaaagttagccaggcatagtggtgtgtgcctgtaatcccagctactcagcaggctgaggcaggagaattacttgaacctgggaggcagaggttgcagtgagccgagattgcgccattgaattccagcctgggcaaca

SEQ ID NO: 15291 - DNA, 480 bp, Homo sapiens
ggtgatctacggatccttcgggagccttacctactgtccaccctgtcttggctgcttagtccagcagctcccacacatggctgcactgccagcttgcccttcaaggtcagcagcttaactctttctctgggcaccagaactcaagctatgtcctggctcccctctttccattttgcagatggacagctctggttttctctctctttctctgggcgccagcgcaagagtgcatgtacagtgtcagcagggcagttataccttttacagacaacagtggtgtagggccaagggatgcccttcctatgttatggctacatggctgtgataacaagtagagttatacacctgccctctaaactcactgagtcactctggatgtttacctcagcctacccttgaccaaagcacaaccatgttccttgcagctgtcttctccctgtgtcctcgcatggtctcccttctgtgttgatctgtgtcctc

SEQ ID NO: 15292 - DNA, 732 bp, Homo sapiens
ggatcatatagtttcactgggacctcttttttgtttacgtaaaatatacaggaaacccaaaacaaacacatcagcatagatcaagaagacaggctgtaaactttggcatcttctttgcctcctctcttacacatgttaacacagacctcccttccccacttccctccctcctgttgtcaccttgtcaatgcctcttgtgtgctctccctcacctctcaccttcctaactctgctttcttcctctatactcagctgcagtctctgatgtgtgcaatcacgtccctcctgctctcattgcctagggaattaaaaccaaactcttactgtgttcttcatcctcctgcctccttctctccttgcccacaccctaatcctcattcaaaatacacgactgatgactggtccacatttcctaggagttcctaatgggattaggcctgctcacacctaaaatgaaaagggcactctggaaatagggaaggcaagagctatcagtagccgttgttgtcactcatggggtcagaaaagtcacccatctgaattattctgtaccttttgagttgaattgatttgtaaggttaagagaaatcaagttgaaacaaatatacatatacattcagctgtggcacgtaaactaagcttcaggaaaatgaatggattccatatttgtacctgatggtaaatctctaaatgcagaaccttttatacattctaaacaggaccaataagctt

SEQ ID NO: 15293 - DNA, 645 bp, Homo sapiens
ctgtatcccggggagggaagtggggaagggaggtctgtgctaacatgtgtaagagaggtggcaaagaagatgccaaagtttacagcctgtcaccttgtcaatgcctcttgtgtgctctccctcacctctcaccttcctaactctgctttcttcctctatactcagctgcagtctctgatgtgtgcaatcacgtccctcctgctctcattgcctagggaattaaaaccaaactcttactgtgttcttcatcctcctgcctccttctctccttgcccacaccctaatcctcattcaaaatacacgactgatgactggtccacatttcctaggagttcctaatgggattaggcctgctcacacctaaaatgaaaagggcactctggaaatagggaaggcaagagctatcagtagccgttgttgtcactcatggggtcagaaaagtcacccatctgaattattctgtaccttttgagttgaattgatttgtaaggttaagagaaatcaagttgaaacaaatatacatatacattcagctgtggcacgtaaactaagcttcaggaaaatgaatggattccatatttgtacctgatggtaaatctctaaatgcagaaccttttatacattctaaacaggaccaataagctt

SEQ ID NO: 15294 - DNA, 1054 bp, Homo sapiens
gtggaccaggagttggggagaggaggagggtgcctgaggccatgactatagggacttctcagagaaggacacttcagggggcagttggtgcccccatctgggaacgttctgcaggtccgagccctctgaggacggtgagggcgattgataacctctgaggttccgtccacccctaggggcccctatcttgggaacctctggatccttgtacggttcagttcctagaggtcacagcagggacacacaccggggaggaactgcgattatatgggggaagtggtgacatttttagagctttctacagaacattctcctggttcctgctctctattcgcagggtgagcgcccactggaagcctcgctgtgcttctgctttctcctgtagtccttggaagcaaggacttcttgttcgttctttaggaacggaagcaaacgttctcgttcagatatgtgcctctccctggtgaaggaagacctcacttcctgggatttttctgtgggatggagcagccagggaccccatctctggtgggggcggggcggaggggggtgcaccatgggcttagagccctctgggccagtgctgcctagtctgctgcatagcccatttgttttgtagacttgcagtgccaaatttcagctttctgggctccaactacgggcttgagctcagtgctgccctagagggtcctgaatgccttcacttatggaaccttagagttgcagagaccatcagagatgatccactttcctttaaaaaaaagaaaagagggctgggtagggtggctcacacctgtaatcccagcactttgggaggccgaggtgggtggatcacttgagttcaggagttcaagaccagcctggccaatatggtgaaaccccgtctctactaaaaatataaaaattagccaggcgtggtggcgggcacctgtaatcccagctactcaggaggctgaggcaggagaattgcttgagcccgggaggcagagaggttgcagtgagccgagatcacgccactgcgctccagcctggatgacagagtgagactccgaga

SEQ ID NO: 15295 - DNA, 263 bp, Homo sapiens
ctgtgatttttttttggtggcaaagtcacagatattactcatataatgatgatttgttcataggcccagaatagaaggaaatgctacattttacttagaggtcagtgaaaaggaagatgtgattttccaagttcatggactccctgagttctggttccaaggaaagatcttgaagttggtggttggactttgagtcctgcttggaggtctcaccccctccccctgcccgtttgcgtgtgcttgggcccacccccagtcgactg

SEQ ID NO: 15296 - DNA, 3725 bp, Homo sapiens
gcggcggcggctgcggtggcggcagcgaggcgagcggggcgggggcgcgggcgcggcgctcggagtccgttcggggccggaggcggtcggggccgggcccgggaagcgcgaggagcgcgcgtagccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagagaggagatggctgaagggaagaatgccatcctcattgggatgagccagtggaactccaatgacctcgtggagcagatcgagaccatggggaaactggacgagcatcaaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgacgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttaccccgtctctgtccacagccctcggggggtggggtctggtgctgacggtctgtcctgcagctgtccattgtccccaaccccgttgtcctcagtgtcct

SEQ ID NO: 15297 - DNA, 2827 bp, Homo sapiens
gcggcggcggctgcggtggcggcagcgaggcgagcggggcgggggcgcgggcgcggcgctcggagtccgttcggggccggaggcggtcggggccgggcccgggaagcgcgaggagcgcgcgtagccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagagaggagatggctgaagggaagaatgccatcctcattgggatgagccagtggaactccaatgacctcgtggagcagatcgagaccatggggaaactggacgagcatcaaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgacgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccaggattgcttgagcccagggttcaaggccagccctggcaacatagcaagacgctgtttctac

SEQ ID NO: 15298 - DNA, 2325 bp, Homo sapiens
cctgaaggaacctgggttggcttcctaggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgacgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttaccccgtctctgtccacagccctcggggggtggggtctggtgctgacggtctgtcctgcagctgtccattgtccccaaccccgttgtcctcagtgtcct

SEQ ID NO: 15299 - DNA, 746 bp, Homo sapiens
accatgttggccaggctggtctcaaagtcctgaccacaggtgatccacctgccttggcctcccaaagtgctgagattacaggcgtgagctactgcacctggccaataaaagacacattttaattaaaataatgacatgtttctaaaatattctgaaatagaaggcacatcacagaatttaaatatttttcaataaaatctgtaatcaaaccatagttcagcttcctctgggatattgtgaactatgtttaaaatgcgaccggaattttccactgctgttcatatttttaaatgcttagaattagaaaaattagccaggcatggtggcacatcgggaggctgaggcaggagaatctgcttgaacctgggaggcgcaggttgcagtgagccaagatcacaccattgcactctagcctgggcaacaaaagcaaaactgcgtctcaaaaaaaaaaagaattagaaaaattttgatgtcttaatttctaatagggttagacatcagaagtagtaaaatttctagctactgcctgcatgcaaaccactcttaataaattcccagtttatcaaaaaatagtttgggaaatgaaaaacagcaaatttcttgagcagtcagggcaacactgtatattccatagtgaagtgctgtatattccataatgagtttgcacttttcaaataactaaaacgcatttagcactgaaactgggctaagcagaatttattttttctttggttcagaatttcaga

SEQ ID NO: 15300 - DNA, 1488 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagacagaagaacgaaagaaggggctccttggagtctaatataagaccaccgacaaaacatgttacaggaaaatatccgaggggaacgagcatgcggagcaaacaaagacaaagcgcacgaagaaaaacaaaggctgcagacatacaggccaatgacagggaacacaagcacaccacagcatcggataccacaagggcagagaaaacaggagaacggcacggagaatcgagaaaatcaacc

SEQ ID NO: 15301 - DNA, 945 bp, Homo sapiens
gagcagtagctgtagctgagtgtctccatcagggaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggaagcgctggcacatgctgctgagcgctactggacgggctccaccgggtataactgagctgctgacaatccgtgggctggctggcgaggcggcgggatcagcccgggggcgggcgagccacgggcagagctggacggtgcacggtctcgaaacgccggaggaaatgggatggcacggcggtccggcgacccggagggcacaccgcaccacggccgaccggcgagtgtcggagcccggaggcacgcgcggcgggggaagttccccacggggccagcggggcacacga

SEQ ID NO: 15302 - DNA, 5415 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15303 - DNA, 2447 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15304 - DNA, 5104 bp, Homo sapiens
tgcaggcggtacggcccgggatttaaggatcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15305 - DNA, 4596 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagacaccacacaaacactcaaacgcggccccgccaaagcaccccagggcgccacggtcgacgctacccgtctgcaccggcggccccaccggccgccaaacccgcccggcccgtaacggcgcgggccacggcaccgcgccagggccccccaaggagacctgcgcactcaccgccacccggcacatcagcctgcccccctgcgcgcacctccgtttaccagcgagcccacgccgcgcgcccaccccacacagagcgcgcggcatccgcgccccgcacaccacccaccccccgccaccgaacgaccaccacccacccacac

SEQ ID NO: 15306 - DNA, 4407 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaggggggggcccggtcccaaatcggcccttagtgagtcgttttacaaatcactggccggggtttaacacgttggaactgggaaaccctgcgttccccaattaaatggcttggaggccatcccct

SEQ ID NO: 15307 - DNA, 5209 bp, Homo sapiens
  misc_feature (16)..(16): n is a, c, g, or t
cttaggtcagtagagntcggtggttttatttggccggaggctcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15308 - DNA, 5051 bp, Homo sapiens
gccagggtggcggcgcccagtggcgaggcgagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15309 - DNA, 5282 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15310 - DNA, 5285 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15311 - DNA, 4213 bp, Homo sapiens
aaccgagtagcccgacagtccccgactagcccgacagccccgactagcccgacagccccgactagcccgacagccccgactagcccgacagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaagaaaaaaaaaaaaaaaaaacggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccggggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtt

SEQ ID NO: 15312 - DNA, 4221 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15313 - DNA, 4370 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggatgtgactgactggtcacgaacagctcccgtcttgccaaggcttggtcgccaggtcatctatcttgatgaagactaggcttgcctagtctcctcctcgcagaatcgacgtcctttacgcttggagaaggggtccctgtagaggaagttttccctctatccccaacgcataccatacccttgtcatgacaacccatgtacgcacgagccccggggggttgtcctaccccatgtcgtctctgtcgcccacgaaggcctatcatccagatccatacaaagattcgacatattgattcgtccatacgaacgagatcaatgagccgtatttcatccagacgttcatggtgatagtctagagcatgcacttgtcggacacaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15314 - DNA, 1872 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggtgagtgagcccgcccagtctcaggtgacactgcagaactacatctcccagcaggccccagggtagcctgcagcgtccctggctgggcccctgcccccggaggctcatgggaattgtagtttgtttagcctggttttgccctgcctctaattatagtggcagcatgccggtgtaaaatcgttccccctctcggggcctcagttgctacttctgtaaagtcagcctcactcagcagaagcaatgtactgagtcctgtggactcaatagccagccttcctggaatcttggccgtccaggttatggagaaaccttgaggagttagttgacctcttagttgcctcaagtgttgaatggagtgaatgctatttattactggtttcataggtagatagaaggactaaatgtgataaaatgtgaaatgtatttaatgtgaggcctgaca

SEQ ID NO: 15315 - DNA, 3597 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagtttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccaccctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttctgaagatgcgcgcctatgactacatgtgcatgggcttcgtgctgctctcctttggccgaa

SEQ ID NO: 15316 - DNA, 2008 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15317 - DNA, 2083 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15318 - DNA, 2787 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagaggtcaggcggcgcgagggaggcttcccaagacccagcagcccccacctccaagggctggctctgcccctagccgggaggagagcggggagcaaggggccagggccaccacctttttgagcagagtgtcgccccctcggcaaccatggcctgccagcccctgtcggtagggaaaagatccctggtactgacagatgccccttgttgctagcgcttgtcaccccgcagtgtggtgaactgccccctgtcgctaggaaaaggtggtaacttagcaaccctgtgccacccctctgttgccacagaagtgtcaccccccagaaccagattgttcctgcttgctggggatgccatcctttgctagtggtgggtcaccctctgttgctagggaaacggttccctagcaacagaacgccactatttgctagggaagcaggatccctagcaacagtagctcacctcctttttaccagaagttttgctctgttgctgcagatacggcactccctgcactgcccctttgttgctaggagctagcactgctccaccccgtgggatgtcctcacatagcagccctcagcagccctctgcaaggaaatagcaatttccaatccctgaccagtgctgttccccagcagagggcacgccattcctaccaactacagttacactgttgctaaggaagccaaacctccccctggaaactatgggttgacccttgttgccagagaggctccaccccccggcacctgcattgctaggcaagtcgcacggccatagctgtggactctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggtttgatgaggtcatcaaacccttactccagtatgtcaccaacttaattcattacatctgcaaccaccctatttccaaatgtcacattctagggtttcgatga

SEQ ID NO: 15319 - DNA, 2317 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15320 - DNA, 1491 bp, Homo sapiens
ccgaagggagaccccgcctcattcctcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagacagaagaacgaaagaaggggctccttggagtctaatataagaccaccgacaaaacatgttacaggaaaatatccgaggggaacgagcatgcggagcaaacaaagacaaagcgcacgaagaaaaacaaaggctgcagacatacaggccaatgacagggaacacaagcacaccacagcatcggataccacaagggcagagaaaacaggagaacggcacggagaatcgagaaaatcaacc

SEQ ID NO: 15321 - DNA, 1759 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15322 - DNA, 1046 bp, Homo sapiens
ctaggctagtacgaggctctgtttatgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15323 - DNA, 1093 bp, Homo sapiens
ctggactcctggatctgggggcagtgggcactggggacctggactcgtaggtcctgactcccagcctcctcctcaggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15324 - DNA, 976 bp, Homo sapiens
  misc_feature (1)..(1): n is a, c, g, or t
  misc_feature (898)..(898): n is a, c, g, or t
  misc_feature (933)..(933): n is a, c, g, or t
  misc_feature (938)..(938): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacagggaaatcantgaacagggccccgttcttttcccgcttaacccgnaaccntacccttgggaacttggcttgggaaaccaagccccttt

SEQ ID NO: 15325 - DNA, 1010 bp, Homo sapiens
gatcctatatcatcccccttcgtctggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15326 - DNA, 379 bp, Homo sapiens
cggtacccctcgataagggccaatataccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15327 - DNA, 994 bp, Homo sapiens
  misc_feature (1)..(1): n is a, c, g, or t
nggtgcactatagacaagtttgtgcaaggagcaggctggtacggtccgggattccgggcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcgctcctggcgccctcttctcatcgcttggcctatgacaggtcaccgtgtgtaaatctttcccaataaagtgttgcacaaag

SEQ ID NO: 15328 - DNA, 282 bp, Homo sapiens
ttagagggtcatgcactgttgtcatacccggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaacaacagtgcaggtatgaacaacagtgcaggtatgaacaacagtgcaggtatgaacaacagtgca

SEQ ID NO: 15329 - DNA, 205 bp, Homo sapiens
gcggtcgctactactactaaattaacaaccgttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15330 - DNA, 2416 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15331 - DNA, 2443 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15332 - DNA, 2510 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtgagggttctatccccgtaagggcaaagggaaccctttggcgcttgggcctttttcgaattgacggcgaaccggccgggggaaagtcccccgggacccggggaggaccccgggtgaaagccctgggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15333 - DNA, 2100 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacgacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15334 - DNA, 3843 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaagtgagtgctcagccaggctcccgccaccggtctcaggcatcctgtgtgtgcgcgcgtgtgttgtgtgtacatgagtgtgccgtgtgtgtcgtgtatgagtgtgccgtgcgtgtgctcgtgagtacgtgtgtgcgtgccgtgtgtacgagtgtgctgtgcgcgtgctcgtgagtacgtgtgtgcatgttgtgtgtacgtgtgctgtgtgtgtgctcgtgagtacatgtgtatgcgtgtcgtgtgtacgagtgcactgtgcatgtgcttgtacgtgtgtgcgtgtcgtgtgtacgagtgcgctgtgcgtgtgcttgtgagtacatccaggtagctgttcatgtaggctcgtgagtacatgcaggtgagtgcgccctcacacccgctgtgtgcacacgtgttcgtcttaacagcatggcccaacctggttggtggtggctgtcaggagggaagtgggtgaagccgttgctgacctaggcgccgcccaggagtccggtggggagcgtgtgagctgtgcctgggccagggcagagtcgggcctcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcctccctgtgacgtcacacgtgaaggaaacggaaaagggcagtgagtccttcgccccgcggcgccgtgcgcacgtcagccttcagggtgattccgctcctccagaggggcaggcgcgggtgtggggggtggggcccaggcccatcctgaggggtcccaggcatgaggggctctgagctgtgtcctggggtggtctgggccatggggaggttctggatcatgtcttgagaggtctgggctgtgtggggggtccaggccatgtcctgggggtctgggctgtgtctgtggggagtcagggccatccatgtattgggggtctggggcaggggggggtccaggctgtcttggggagtccgggctgtgtggaggggtccaagctatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15335 - DNA, 1261 bp, Homo sapiens
agaggatcccccaactgcaacgccggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15336 - DNA, 2521 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaagcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15337 - DNA, 2532 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagaacgtgcccacactcccgctgcagccaataggcaccttaaatagccacttcgtgcggctggccgcggagctcggagggggaaaggcgacgctgacctgtgccccgctcgcccgcagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15338 - DNA, 3939 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaagtgagtgctcagccaggctcccgccaccggtctcaggcatcctgtgtgtgcgcgcgtgtgttgtgtgtacatgagtgtgccgtgtgtgtcgtgtatgagtgtgccgtgcgtgtgctcgtgagtacgtgtgtgcgtgccgtgtgtacgagtgtgctgtgcgcgtgctcgtgagtacgtgtgtgcatgttgtgtgtacgtgtgctgtgtgtgtgctcgtgagtacatgtgtatgcgtgtcgtgtgtacgagtgcactgtgcatgtgcttgtacgtgtgtgcgtgtcgtgtgtacgagtgcgctgtgcgtgtgcttgtgagtacatccaggtagctgttcatgtaggctcgtgagtacatgcaggtgagtgcgccctcacacccgctgtgtgcacacgtgttcgtcttaacagcatggcccaacctggttggtggtggctgtcaggagggaagtgggtgaagccgttgctgacctaggcgccgcccaggagtccggtggggagcgtgtgagctgtgcctgggccagggcagagtcgggcctcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcctccctgtgacgtcacacgtgaaggaaacggaaaagggcagtgagtccttcgccccgcggcgccgtgcgcacgtcagccttcagggtgattccgctcctccagaggggcaggcgcgggtgtggggggtggggcccaggcccatcctgaggggtcccaggcatgaggggctctgagctgtgtcctggggtggtctgggccatggggaggttctggatcatgtcttgagaggtctgggtgtgtctgtggggagtcagggccatccatgtattgggggtctggggcaggggggggtccaggctgtcttggggagtccgggctgtgtggaggggtccaagctatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctgggtgaggctgggtccagcctggccggcacgccaggacccaggaccgactggcaggggccgggcatcgtcgggaggtcggggcaggtcctgcgggagccccagcctgggtgtgggctgacccattcccgtctcgcagaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15339 - DNA, 2580 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcaaaaaaaaaaaaaataaacgatattatactaaaaaaaaaaaaaacgcgggggagtttttttgggggggggaaaaaaggtatataagggacgggtatatgttttctcgacccctttttgtgaaaggggaaaacggggggccccatggggggagaaatgaacacgtc

SEQ ID NO: 15340 - DNA, 2541 bp, Homo sapiens
  misc_feature (2418)..(2419): n is a, c, g, or t
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcacnnacacaacataaaacaccagggaaccaagcgggagagggcggacaccgcgcatgcaccggcccatggtcaaaatcgggggccggccccgttcttgcccacgggggacacgcgcgggccccaaa

SEQ ID NO: 15341 - DNA, 2752 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcaccaaaaaaaacaaaacaaaacaaccaaaaaaacacgctgttgtggggcggcgccgtggagcacacccgaagaagaacctctcttagaacaacaatattacaatgtgggagcgccgcggcggcccccaaaagggggaaaacgaggaacaccacggtggacaacgaaccaggtgtctccccataggaacaaccccgcgggccaccagtacaaaaaggccgccgaggaaatccaccccacccaataaacaaaaaccgcccccgggggagcacaaccgagaacgcggctgtgagaacaccaaaccccaagagaggcaccacaacacagcgcacacacagg

SEQ ID NO: 15342 - DNA, 2455 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcacatcacgctcgccctctatggtgatagccaccacataca

SEQ ID NO: 15343 - DNA, 2550 bp, Homo sapiens
  misc_feature (2550)..(2550): n is a, c, g, or t
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgacaagaagctctctgtgcccgagttcatctccctgcccgtgggcaccgtggagaaccagcagggccaggacatttgacgacaactgggttgaacagacagaacaacaggacgtttcgaggagctcattgactccaaaccacgacggcatcgtgaccgcccgaaggagcctggagagctacattggaccccatgaaacgagtacaaccgcgctggccgtgtccgcgagccaacccagggtcccgcaagcttggcgctgacgaaccatgccaatattcggtccgcgacaagaattcacatcacatttacctttacactcttcaccacacactcan

SEQ ID NO: 15344 - DNA, 1998 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15345 - DNA, 2031 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcacaaacaaccaaaccccaccaaaaaacccccggggctttttgggggggcgacaagagtttaagggccgggctttttttccgcccttttttcaggggaaaccgcggcccaagggggaaaaa

SEQ ID NO: 15346 - DNA, 3094 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaagtgagtgctcagccaggctcccgccaccggtctcaggcatcctgtgtgtgcgcgcgtgtgttgtgtgtacatgagtgtgccgtgtgtgtcgtgtatgagtgtgccgtgcgtgtgctcgtgagtacgtgtgtgcgtgccgtgtgtacgagtgtgctgtgcgcgtgctcgtgagtacgtgtgtgcatgttgtgtgtacgtgtgctgtgtgtgtgctcgtgagtacatgtgtatgcgtgtcgtgtgtacgagtgcactgtgcatgtgcttgtacgtgtgtgcgtgtcgtgtgtacgagtgcgctgtgcgtgtgcttgtgagtacatccaggtagctgttcatgtaggctcgtgagtacatgcaggtgagtgcgccctcacacccgctgtgtgcacacgtgttcgtcttaacagcatggcccaacctggttggtggtggctgtcaggagggaagtgggtgaagccgttgctgacctaggcgccgcccaggagtccggtggggagcgtgtgagctgtgcctgggccagggcagagtcgggcctcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcctccctgtgacgtcacacgtgaaggaaacggaaaagggcagtgagtccttcgccccgcggcgccgtgcgcacgtcagccttcagggtgattccgctcctccagaggggcaggcgcgggtgtggggggtggggcccaggcccatcctgaggggtcccaggcatgaggggctctgagctgtgtcctggggtggtctgggccatggggaggttctggatcatgtcttgagaggtctgggctgtgtggggggtccaggccatgtcctgggggtctgggctgtgtctgtggggagtcagggccatccatgtattgggggtctggggcaggggggggtccaggctgtcttggggagtccgggctgtgtggaggggtccaagctatgcctttggggatcaggcctgtgggaggctctgggttatgtcttggcgggggtccaggctgtgtcttaggggctgggccatgttctggggacgtgtgaatcctggagggtggggccccggtctcgcgggtggctgtgtccctcgagttcaggcagcacctctcggaactttctggatttgcgtgctggcgtctgtcggcctcgatacccacaggctgcgcccctctcagcacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacacgacccaaaacgacactaccggact

SEQ ID NO: 15347 - DNA, 1153 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgagcttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15348 - DNA, 265 bp, Homo sapiens
cccactgctgagtgagtcatcttgtttttatgtagaatcctgtgattcctggcgacagccagtgggcccggcccaggttagggatccttcagaactggggtccaggcctgtgtagcccctgtgccccgttacccctgctggccccgggcaggccttccggggcccccggcttctccctgccctgtgttttcatttgtgccgcctcccttcgggaaccttccagaacgtgcccacactcccgctgcagccaataggcaccttaaat

SEQ ID NO: 15349 - DNA, 538 bp, Homo sapiens
gtgcctctcctggatgggtctcagtttggccccgtccatccatcccaggagctgcggtggagcagacagggaggggtgccccaggaaccacagccccgtcactcctgtcttcctttaagtgaaccggtcgtgtagatggaggttgttcagaaagggataagatgggacggcagctgggcctcatcccgcagtgagcgcgacgcagaggctgccgggcttgtggcaggggcttcggccagggcagagtcgggcctcacgtgcagggggctgagtgtgggcctcaacactggacttggccactgactgcagtgagccccaagatggggcaggaggtggtgtttctgtcctggagacccagggtggcttgggtccttgggatgtgtggggacctcggggtgagggcccgttggggccgggtgggcacggcaggagagcgggggccacacacccagaggcagtgccgtgtcccggctgggagggttcctgggaagctctgctcagccccagtctcagtcatttctagaaactgtgttttcct

SEQ ID NO: 15350 - DNA, 2761 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcaaaaaaaaagaacaaaacaaagaacagaacaaatagacaagaaaaaaaaaggacgggggcgcgcgcgccgcacaaaaaactatccccacagaagggggcgcacaagataagcggcatcaccacggtatgcatggcaccaaagggcgccccccatataatgagaagagcgagaaataaatagacacgcccataggaaccgagaggcagaccgagaagataaacaacaggagccgaggacaagggagaaaacaaagtgcaacaactgaggcagagacacgttgcaagagagagccaactaaatgctagggaagggcgaaacaaaccagggcgcacacagcacacatag

SEQ ID NO: 15351 - DNA, 2986 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcacttttttggtcagcttcattctttgggcgtgaaacaaaacaaaaaaaaaaaacactaacaacaaacaacacacaaaaacacaacacacacacaaaaacaaaacaaacacaaaacaaagagggggcgcgacacacaaaaaaagaaactcccagaaggagacaacacataatcaaacacccacagattatcaggataacaaaagggggccccaaaagaagagacgagccaaaataaaagaacagagacagacaggcgacgacgcataacaacgaacagccaagcgagcacgaaaacacacgaacaatagcgcgacaaacaccggacgaagaagaacaacaccacccacacccgacgcgacgagagcacgaaaaacaaagagaggacacaaaacaaccacaccagaacgaaaaatataaaaaccaagcccacgcggaagaaaacaaaaaaacaaagatgagcgatgcaaacaacagcggacaaacaccagacacccacaaacaaacagagcagcgctgagaaaaaagatcataaaaacagagccaatacacaacacacaaaaaattaacgcgc

SEQ ID NO: 15352 - DNA, 2086 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccggctgtggccccgcggcgccgcctcctccctggtccctcgaaatcgtggcatctcacttctgagaacgaaatctcgcttcagtcactctgccgaaggcgctgacggcatcgcggccggaacctctgggcccggcccctcccagggccgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttca

SEQ ID NO: 15353 - DNA, 2927 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctgcagcgcgcaccccggcggggctttggctgtgacgcggtcggggcgcggggctgggctgtggccccgcggcgccgcctcctccctggtccctcgaaatcgtggcatctcacttctgagaacgaaatctcgcttcagtcactcgccgctccgtgggaaaaaacagctcctccatttccttgaaaactgaacgattattaaaaatagattaaacttcgctggaaatgagtagccaggaagttcaggggagggtgccgggtccttcccgggcctggcgtgtcggagccacccaggtcccgcagctgccgctgagaaaatgcaaatatttgttgtgacaagaatcacatacatttactttaaatatagttgccttttttggtcagcttcacttttttggtcagcttcattctttgggcgtgaaacaaaacaaaaaaaaaaaacactaacaacaaacaacacacaaaaacacaacacacacacaaaaacaaaacaaacacaaaacaaagagggggcgcgacacacaaaaaaagaaactcccagaaggagacaacacataatcaaacacccacagattatcaggataacaaaagggggccccaaaagaagagacgagccaaaataaaagaacagagacagacaggcgacgacgcataacaacgaacagccaagcgagcacgaaaacacacgaacaatagcgcgacaaacaccggacgaagaagaacaacaccacccacacccgacgcgacgagagcacgaaaaacaaagagaggacacaaaacaaccacaccagaacgaaaaatataaaaaccaagcccacgcggaagaaaacaaaaaaacaaagatgagcgatgcaaacaacagcggacaaacaccagacacccacaaacaaacagagcagcgctgagaaaaaagatcataaaaacagagccaatacacaacacacaaaaaattaacgcgc

SEQ ID NO: 15354 - DNA, 2232 bp, Homo sapiens
tcatcgcgtgttccagacagcgatgactcgagagcggggagagatggtggcgccggcgtcccctccgtgaggtcgcgcccgttcgcaccgcccccgcccgcaagaaagatggcagtggcctgatccgggcccgttggcggcgtcactgacgcttcgctccggtcctcggatcccgagcgcggggaggcagaccggtgagtgaggggcccgggacggccgctgcaggccgcggggccaagtgtacgccggccggacggcgagggcgggtctggaggccgccgccgcctcccgccttgggctggggcatcgtccgtccgctcggccttgagccctggcgagactccgccgccaccggggctcccgggggcagggacaggccgacgacgctggcctccccggccgccggcacgtctggtctcctactggccaaaacctacgaatgccaccgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggacgcggagccgcggcggagccggaggaagctgatggtcatcttttccaaggtggatgtgaacactgaccggaagatcagtgccaaggagatgcagcgctggatcatggagaagacggccgagcacttccaggaggccatggaggagagcaagacacacttccgcgccgtggaccctgacggggacggtcacgtgtcttgggacgagtataaggtgaagtttttggcgagtaaaggccatagcgagaaggaggttgccgacgccatcaggctcaacgaggaactcaaagtggacgaggaaacacaggaagtcctggagaacctgaaggaccgctggtaccaggcggacagcccccctgcagacctgctgctgacggaggaggagttcctgtcgttcctccaccccgagcacagccggggaatgctcaggttcatggtgaaggagatcgtccgggacctggaccaggacggtgacaagcagctctctgtgcccgagttcatctccctgcccgtgggcaccgtggagaaccagcagggccaggacattgacgacaactgggtgaaagacagaaaaaaggagtttgaggagctcattgactccaaccacgacggcatcgtgaccgccgaggagctggagagctacatggaccccatgaacgagtacaacgcgctgaacgaggccaagcagatgatcgccgtcgccgacgagaaccagaaccaccacctggagcccgaggaggtgctcaagtacagcgagttcttcacgggcagcaagctggtggactacgcgcgcagcgtgcacgaggagttttgagcgcccggccgcgccccgcgccgccccccacgcaccaccggggcggcctcgcgggtgactccgggctccgtggctgtcccggaccccacctcttccctgccgcccgccaccggccgaccgaccgcggctgccccagttgatgagcggcgtgtcccctctggctcctgggggcagtccttttgatggacgcgtttgcacggcctgccaaccacttgtccactcgagagagagtagccaacagggaggagaatgagatcctgcccccagaccacctgaacggggtgaagctggagatggacgggcacctcaatcgcggcttacccaggtcccgcagctgccgctgagaaaatgcaaatatttgttgtgacaagaatcacatacatttactttaaatatagttgccttttttggtcagcttca

SEQ ID NO: 15355 - DNA, 1093 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtacccaggtcccgcagctgccgctgagaaaatgcaaatatttgttgtgacaagaatcacatacatttactttaaatatagttgccttttttggtcagcttca

SEQ ID NO: 15356 - DNA, 1064 bp, Homo sapiens
ggcccgcaagtagaagcatggcaggtgcgtcctggatcgcgtgcgcccggttcgagcgcgcgatcacctcgacgacattcggtctccggggtcgctcggagcatcccagacgcgcaggggcaggcatgacgcggtagtacgttagacggcgtgcgcctggtgactggaccgctgtcgaggtctgctgcgcgtgtccatagtgctgcgccaggtcgggcactggctgagggcgggtcttggatggccgtcgccgacttcccggacttagaggcttgcggagcttactgtccctgtgtctctgactctgcgctctttgacgcctctgtggcagagactgctcgccgatcaggcgagggctacccgcggggcaagtggatcacgtgccgacgtatgctcggcctgccccgtgtccgtcgggcatgtgctggtactacctatactggctcaagagaacctatcgatagtgcgcatcgcgggaaacggaggcccaaggggtctggttggactcgcgtttatcggcgaggcgaccttggacaagctgccccgcttccctgcgcctgcgcttccgcttctgaaccgcgtggaccctcatccccgactgtgagctgcttgtccccatcctgcggccgtcctggggacacagagccctccgtggtgcccggggattggattggagccaggacctcacttcctcctctgcccctgcccctgcccctcccagcacctggcccacaccctgcagcccgccccatggtctggccctgggtggcgatggcgtccaggtggggtcccctcattggcctggctccgtgctgcctctggctcctgggggcagtccttctgatggacgcgtctgcacggcctgccaaccactcgtccactcgagagagagtagccaacagggaggagaatgagatcctgcccccagaccacctgaacggggtgaagctggagatggacgggcacctcaatcgcggcttccaccaggaggtcttcctaggcaaggacctgggtggctttgatgaggtgatgcctgccaggtggagtcctctgagtgtgaaagt

SEQ ID NO: 15357 - DNA, 360 bp, Homo sapiens
caaagaggtgccagcttgtgcacaaaatgagagaggagaaaagggtgggaggaggggccctggctctttttaacaaccagctcttgggggaacaaatagagtgagacctcaagcatgcctgaggaagagcattaatttattcttgagggttctgacccctccccaccatgcccaacaacatctcccattaggccccacccccaacattgagatcaaatttcaacaggagggacaatcatctaagtgatagcatagactcaggctatttactattctgttttcaagtatagattgagggcaacagcagcctttgttttctatgttgatggccaaaggtttatttttatattcttatactgt

SEQ ID NO: 15358 - DNA, 360 bp, Homo sapiens
gttgtttacaaggtcacaggcagccacaaacatgataaaaattcattcctgtacaatggaatttgtttctatgaatggaattttttttctatgttcttatttgcaatgtatcttcataccatactgtacctgatatggtaacttttgcccatcccaaaatgaggacagtactccagccctcaatccctagtagccactgaactcagaggacgaaggtattgtgatggcttggggaatattttgggattcctgagtagtcttttcctggcccagcttgatacaaccaggcagtcttgtgggaaaagatgcatataatgacaagtgagtaaatgaagtgaacaaatagaagtctataacaaa

SEQ ID NO: 15359 - DNA, 349 bp, Homo sapiens
gttgtccaggctggagtgctgtggcactattacagctcactatagcctcaaactcctgctctcaagtagtcctcctgcctcagcctcctgagtagctgggactataggcttgtgctcatgcccggctaatatttttattttttgtaggtgagggtcttgctctgttgctcaggctggcctcaagcaatccacatgcctggacctcccaaagtgctgagattacgggtctgagctaccgagcttgccattatattggttcttgaaatcccattgcagtagccacctttatccagaagcatgtattttaattctctagcaggttcggatctctcccttccgtggtcctact

SEQ ID NO: 15360 - DNA, 355 bp, Homo sapiens
tccttcacagaatacaagcaactgaagtaagtagatggcaacacaggcattgatattaagtccagaccagatttaatttgtaaacataggcttttcttagtctttcttgctcttttcacagaaaaactctgttttctggtgacacgttttaaagaagcactaatttctgccctgagtcactttttacaagttgttaactttttataagtttttaaagtgattttttacagccaaaaccaagggatgatcattgtcccacacatcccagctgatgacgtcaacgagcaaagagatgaacaaaatagtcaaaaagcaatgaatccattctgcacatgtaccccagaacttaaagtat

SEQ ID NO: 15361 - DNA, 495 bp, Homo sapiens
gcattttacagtcctcttgatacctacagaacactgattggtgctttttacaatcctcttgtaagacagaaaagttctccaagtccccactagacccaagaagtccagctggcttcacctctcactagcacctccatgcagtgaaccagagagagaattcattaagaaacatggccatttaaaaattattgacacctgatcaagtctttgtgatgaagtcacaccatcaagagtgttctcagtcacgctgaacatgcaaatgccactaaaggcagtaaccacctccagtctctctaaaggaagttttatatgaagccgttggacctggaactcaactgtaatcacagaagatttcttgggagagaataactcacccctgtatagcatctaagtggtccccaagacatgtataattttacaagacctagaagttgtataatagaagccaatttttaaaatcttgctttcattaaatgcagaatgttcatcctattg

SEQ ID NO: 15362 - DNA, 407 bp, Homo sapiens
tttgggtggggacacagccaaactacatcaacaactttacatggttatagatatttttgtttataacaacaacacacacacgtgcgcacccctataagttgagagggcagagaaagtgacagtaagagcatcctggctgtcaaggcatattatgcagacaacatctgtctatcaaaaatcacaagccagccacggtggtgttttcttggggttccagctactccagagctgggagcacaggtacatgcaaccatgcccggctaatttttgtattttttttttttatagcgacgagttttcgccatttttcccaggctggtctcaaactcttgggctcaagcgatccacccacctcggcctcccaaagtgctggaattacagatgtgagccaccacgcctggccaaga

SEQ ID NO: 15363 - DNA, 442 bp, Homo sapiens
aggtctccccacccctcccagcggtgcccacccagggcttctcgaggaaggagctcagcacccgccccagtgacacttcacttctctgggctttgctgccttttcctataaaatggggtgccagtcgccctctcagagtcctttcaaggagctgatggtgtagaccgcgagacctgccttgcagggcacatgcgcagctgctcctgtcatgctgggacctccggaccccgggcctcgcagctgccttggatcccctccctcctccagtcacgggctctgggctggctgctgggcgtgttgggcacagcgggccctaagctgacccgtgccctttgtggctgggacctgagatggggaggcccccaccccctagttccatggctttgggaggtgggggtggggtgttttctactctaccaccctacaacgaaaaagaagaaaa

SEQ ID NO: 15364 - DNA, 392 bp, Homo sapiens
cggcacgaggccgccaactttttttattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15365 - DNA, 975 bp, Homo sapiens
ctctaccacaggctgtctggggcgggcaagtgcaggggccttgggcagggctgatgggaggatgcagaccagaagggccactgtggagagggagctgcagcacctgaagactggtgggcgggtgatggaagccacataaactttctgtgcagttcaaattcgtcctgttgtgaaaatgggaatatggataacttcccccagagatgtgtcagccgattagcccgccttactatgctaggaaggagaacacatccctcacttggtccttcatggaaaacacatagtgcttgttgtttctccagcatgttgggttatttggtggataccaggtaattcctgttgtggttttctttctttgccaaggtacggacattgctgcaggagaagaggttgccatcaagcttgaatgtgtcaaaaccaaacaccctcagctccacattgagagcaaaatctacaagatgatgcagggaggaggtaggtctttaccagtcacagagcaacaccagggttctgtttgacaagggagaacagcaactcagcattgctggttaaaataaacccaaaactggttctgggcaaaagggagggaagtgttctccacaccctgacaaagcagtcacagcttccttcagagagtcttgggtccagagaccctccctcaacacaaagaaacatcttatgggccgggcatggctgctcacgcctggaatcccagcactttgggaggccaagatgggtggatcatttgaggtcagtagtttgagactagcctggccaacgtagtgaaaccccgtctctactaaaaatacaaaaattagccaagtgtgatggcgtgcacctgtaatcccagctgtttgggaggctgaggcaggagaatcgcctgagtctgggaggcagaggttgcggtgagccgagatcacgccactgcactccagcctgggcgacagagtgagaccctgtcccccccaaaaaaaa

SEQ ID NO: 15366 - DNA, 346 bp, Homo sapiens
agtcacccggcccgtaccggcatgtgctgtaggccagcgttttccgtaaatggcagcatgaggagtctgggcggtgctggccgcacggtgctgcagccgcaggtgtgtcggtctgtgtgttgcctggtgaacgtggctgtgtccaatgagctgtacttgcaggaagaagtggcacctgggtttggccccggggctgtagtttgcaggcccctgccgcacagcattggcagttagaatctgctttttcataggttgctgtctcggcttaaaatctgacctccccacccccgtgcatctggatagtgcagcacagatccggctgccggccgctggcctacagcacatg

SEQ ID NO: 15367 - DNA, 3739 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15368 - DNA, 3675 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15369 - DNA, 3502 bp, Homo sapiens
agcacagtaatccgatccgaaccacgcgtcgacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15370 - DNA, 3256 bp, Homo sapiens
  misc_feature (3218)..(3218): n is a, c, g, or t
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccacntggtggcgttgcttggccggtgtttcaccggggtgggg

SEQ ID NO: 15371 - DNA, 3542 bp, Homo sapiens
tgtgcccccgggaaggttttctgggcagtatcagatcgaccaggcgtcgatctgcccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcgtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15372 - DNA, 3159 bp, Homo sapiens
aaatagctagtacgagactgggtgtgaatcggcgaggcagctcaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15373 - DNA, 3200 bp, Homo sapiens
gctgtggctgaggggcaggaacaatgcagccactgatgtagtgtcccacagttgagcggtccctccctgagactgccctggggtgccatctcgcgcccttgctctgctcacagatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15374 - DNA, 3537 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgtggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15375 - DNA, 3065 bp, Homo sapiens
ctgtgtcaacggaggacgtgggccggggagggcccaaggctgcagcacatctacacgaggggtcagcagaacgtgcagcggtttccacactcgttgcagacaacaaaggtggtcatgggctcatcagagctgcgggtctgcacctgtgtgtaggtgcagttctttttcctgcacttgccgcaggtgaacgggtctgtctgcgtgccgccagtgcgggccatctggtgctctcggatggcctccttggtcatggccttacggatctccttcagacttgaagtctgaaggagacggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15376 - DNA, 2526 bp, Homo sapiens
  misc_feature (56)..(56): n is a, c, g, or t
  misc_feature (58)..(58): n is a, c, g, or t
ctggaacatgctcaaatttggtgccagccgggccgccgatgacgccgagcgggagnanacaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15377 - DNA, 2451 bp, Homo sapiens
cggatctgagtgttggtggccatcaggccagccaggtcctgactgtccaggcagcccagggtcctctctggccacagcctctcatagaaagccccgagtgagaggcagcagacgggggcggcccactccgtttctctccctgtcctcagctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15378 - DNA, 2777 bp, Homo sapiens
ttttcgggctgttggtgttcggccagggctctttggctacagtagcctgggccctaaaggcatctagttgctgagtctgtttggggtttttacttggtgagaagaaggccttgtcattccaacagtcgatgactcgctttgatcaactcctgcccaggactaggcctgagccctgtcgtcgtaccggcgaggatgtgcgtctcccctgccttcaggctgtgccctgagacccagttgtggggctgcccagcacctgccatcctgctgggatcaggttttcttagtgcttgagaagactcaggagggcctgtcccatgccattgttggccttaagagcaagtgattccagaagaggagtgggcaccactctcatccagaggcccgtcctgagaggcaagtgaggctgtgctctgtgcctgggctcccccaggtggcacctgtcggtctgtggacctggttgaggcaaggatgcccatctggacatggagccgacacaggtagtcagggggccagcgggacgcttaccaacagctgtcttttccccacctcagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15379 - DNA, 2619 bp, Homo sapiens
ttttcgggctgttggtgttcggccagggctctttggctacagtagcctgggccctaaaggcatctagttgctgagtctgtttggggtttttacttggtgagaagaaggccttgtcattccaacagtcgatgactcgctttgatcaactcctgcccaggactaggcctgagccctgtcgtcgtaccggcgaggatgtgcgtctcccctgccttcaggctgtgccctgagacccagttgtggggctgcccagcacctgccatcctgctgggatcaggttttcttagtgcttgagaagactcaggagggcctgtcccatgccattgttggccttaagagcaagtgattccagaagaggagtgggcaccactctcatccagaggcccgtcctgagagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15380 - DNA, 2345 bp, Homo sapiens
acccgtctccgctccactcggatccttcgaccctgccgagcccggtccgcgggcaccttgcttgcatgcctcttcctccttcccgtcttcctgtcactcgttctgctgagcacgtgtcccagccacagaggcccctgtgcgtggcgggggacgaggcgtctagactggggctaggcggtggcgattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15381 - DNA, 2009 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15382 - DNA, 1770 bp, Homo sapiens
gcacacagcttcccaggcctcagcagccgatcagggccgtcagggccttgcctcaaagcatcactccccgaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15383 - DNA, 1327 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggcacttcgtgggcagcgctgcccacgaagtggtggcgcccggagaagcggccagc

SEQ ID NO: 15384 - DNA, 856 bp, Homo sapiens
gctgaggttcccagtgatggagcctggggcacagcagcatggagcctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15385 - DNA, 967 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatggtaaggactgtttcctgacagttggcacacacttgctgtctgatagaatcagccactcgcttgtgctgttcttgccattattatggccattaattcacagaggaaatggaaatttgctgagcctcagccttgaggctgcagtggctcagctcactggcttctcgaggctccggtggctccgctcactggcttctcgaggctccggcggcccagctcactggcttctcgaggctccggcggcccagctcactggcttctcgaggctccggcggcccagctcactggcttctggaggctccgacggctcagctcact

SEQ ID NO: 15386 - DNA, 1004 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggaggtaggtctttaccagtcacagagcaacaccagggttctgtttgacaagggagaacagcaactcagcattgctggttaaaataaacccaaaactggttctgggcaaaagggagggaagtgttctccacaccctgacaaagcagtcacagcttccttcagagagtcttgggtccagagaccctccctcaacacaaagaaacatcttatgggccgggcatggctgctcacgcctggaatcccagcactttgggaggccaagatgggtggatcatttgaggtcagtagtttgagactagcctggccaacgtagtgaaaccccgtctctactaaaaatacaaaaattagccaagtgtgatggcgtgcacctgtaatcccagctgtttgggaggctgaggcaggagaatcgcctgagtctgggaggcagaggttgcggtgagccgagatcacgccactgcactccagcctgggcgacagagtgagaccctgtcccccccaaaaaaaa

SEQ ID NO: 15387 - DNA, 324 bp, Homo sapiens
gtgcgtcccctccctgcccagcaccgtcactgtggtatctgcctggccggctcccccagccccatgctgaccttctcctgtgctttggctccgacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaa

SEQ ID NO: 15388 - DNA, 386 bp, Homo sapiens
  misc_feature (56)..(56): n is a, c, g, or t
  misc_feature (58)..(58): n is a, c, g, or t
ctggaacatgctcaaatttggtgccagccgggccgccgatgacgccgagcgggagnanacaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactgggaagggaggcaggagcacccgt

SEQ ID NO: 15389 - DNA, 3530 bp, Homo sapiens
gaattcccctgtgttagacggtacaggtggaagaagactgctgtgtgcaggaggaatttgcagtgagacttcaaggaagagaataagctcgccacataaagaggaaacaaagagcaacccaggacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15390 - DNA, 3653 bp, Homo sapiens
tgtgcccccgggaaggttttctgggcagtatcagatcgaccaggcgtcgatctgcccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15391 - DNA, 3710 bp, Homo sapiens
ctctaccacaggctgtctggggcgggcaagtgcaggggccttgggcagggctgatgggaggatgcagaccagaagggccactgtggagagggagctgcagcacctgaagactggtgggcgggtgatggaagccacataaactttctgtgcagttcaaattcgtcctgttgtgaaaatgggaatatggataacttcccccagagatgtgtcagccgattagcccgccttactatgctaggaaggagaacacatccctcacttggtccttcatggaaaacacatagtgcttgttgtttctccagcatgttgggttatttggtggataccaggtaattcctgttgtggttttctttctttgccaaggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15392 - DNA, 3296 bp, Homo sapiens
gcatggtgatggagctgctggggccaagcctggacgttgtagtccccctctgccccgcactgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15393 - DNA, 3654 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15394 - DNA, 3607 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagattcctggtcgggtggcttccagtggtcttcagtctgtcgtgcaccgatgagaactctccttattgctgtgaagggcagacaatgcatggctgatctactctgttaccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15395 - DNA, 2962 bp, Homo sapiens
tactctgatctagtacacgatgggggaaggcttaaacgcggctgccaggtgtaattttccaagtgtcaaagatcccaagtgatccctgacacccaccccttcctactcttacattcatgcgtctgtaagatagctgcctacaacaggtcagtagtgatgctccgatcagaaaaacaagatacaaaacaaacaacaaacacacttggtcccttcagaccagtaagatacacaaaccacctccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15396 - DNA, 2559 bp, Homo sapiens
tgggtgattagcaggatcttaggagccttaaccctcgggcggattgatgtggtgggtgggcatcggcaaagccagccaggtcctgactgtccaggcagcccagggtcctctctggccacagcctctcatagaaagccccgagtgagaggcagcagacgggggcggcccactccgtttctctccctgtcctcagctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaatagcattcctttcgaacaccacggcaagtagctgctcgtctcccatcggaaggcagcactggattcctggtcgggtggcttccagtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15397 - DNA, 3025 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgttaacaccgggagctctccaggccactcacccagcgacgctcgtgggggaaacatactaaacggacagactccaagagctgccaccgctggggctgcactgcggccccccacgtgaactcggttgtaacggggctgggaagaaaagcagagagagaattgcagagaatcagactccttttccagggcctcagctccctccagtggtggccgccctgtactccctgacgattccactgtaactaccaatcttctacttggttaagacagttttgtatcattttgctaaaaattattggcttaaatctgtgtaaagaaaatctgtctttttattgtttcttgtctgtttttgcagtcttacaaaaaaaatgttgactaaggaattctgagacaggctggcttggagttagtgtatgaggtggagtcgggcagggagaaggtgcaggtggatctcaagggtgtgtgctgtgtttgttttgcagtgttttattgtccgctttggagaggagatttctcatcaaaagtccgtggtgtgtgtgtgtgcccgtgtgtggtgggacctcttcaacctgattttggcgtctcaccctccctcctcccgtaattgacatgcctgctgtcaggaactcttgaggccctcggagagcagttagggaccgcaggctgccgcggggcaggggtgcagtgggtgttaccaggcaaagcactgcgcgcttcttccccaggaggtgggcaggcagctgagagcttggaagcagaggctttgagaccctagcaggacaattgggagtcccaggattcaaggtggaagatgcgtttctggtcccttgggagaggactgtgaaccgagaggtggttactgtagtgtttgttgccttgctgcctttgcactcagtccattttctcagcactcaatgctcctgtgcggattggcactccgtctgtatgaatgcctgtgcttaaaaccaggagcggggctgtccttgccacgtgccaagactagctcagaaaagccggcaggccagaaggacccaccctgaggtgccaaggagcaggtgactctcccaaccggacccagaaccttcacggccagaaagtagagtctgcgctgtgaccttctgttgggcgcgtgtctgttggtcagaagtgaagcagcgtgcgtggggccgagtcccaccagaaggcaggtggcctccgtgagctggtgctgccccaggctccatgctgctgtgccctgaggttcccaggatgccttctcgcctctcactccgcagcacttgggcggtagccagtggccatgtgctcccaaccccaatgcgcagggcagtctgtgttcgtgggcacttcggctggaccccatcacgatggacgatgttccctttggactctagggcttcgaaggtgtgcaccttggttctcccttctcctccccagagttccccggatgccataactggctggcgtcccagaacacagttgttcacccccccaccagctggctggccgtctgcctgagcccatggatgctttctcaatcctaggctggttactgtgtaagcgttttggagtacggggccttgagcgggtgggagctgtgtgttgaagtacagagggaggttggggtgggtcagagccgagttaagagattttctttgttgctggaccccttcttgaaggtagacgtcccccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacc

SEQ ID NO: 15398 - DNA, 1805 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggccgccgatgacgccgagcgggagcgcagggaccgagaggagcggctgagacactcgcggaacccggctacccgcggcctcccttccacagcctccggccgcctgcgggggacgcaggaagtggctccccccacacccctcacccctacctcacacacggctaacacctccccccggcccgtctccggcatggagagagagcggaaagtgagtatgcggctgcaccgcggggcccccgtcaacatctcctcgtccgacctcacaggccgacaagatacctctcgcatgtccacctcacagaggagcagggacatggcatctctccggctgcacgcggcccgcccagcccgcatgccgtccccagcgcccacgacgcacatactgagggccccggggcctctgaccgggctcccagcacgcaggccactgctggcaccgagagcagatccactctggaatgacacggttcccaccccgccaccttccccctcaaaacactgatcgggcgacgatccgctgggccggcagctggagcccagccgtggccctgcctgagccagtccagtttgtaaaataaatagcaagcgttgca

SEQ ID NO: 15399 - DNA, 1457 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgatcagtcgcatcgaatacattcattcaaagaacttcatccaccgggatgtgaagccagacaacttcctcatgggcctggggaagaagggcaacctggtgtacatcatcgacttcgggctggccaagaagtaccgggatgcacgcacccaccagcacatcccctatcgtgagaacaagaacctcacggggacggcgcggtacgcctccatcaacacgcaccttggaattgaacaatcccgaagagatgacttggagtctctgggctacgtgctaatgtacttcaacctgggctctctcccctggcaggggctgaaggctgccaccaagagacagaaatacgaaaggattagcgagaagaaaatgtccacccccatcgaagtgttgtgtaaaggctacccttccgaatttgccacatacctgaatttctgccgttccttgcgttttgacgacaagcctgactactcgtacctgcggcagcttttccggaatctgttccatcgccagggcttctcctatgactacgtgttcgactggaacatgctcaaatttggtgccagccgggcccgcaggatgacacagccctggaacgcagggggaaggcgccaacgtgggcaaccccggagggaggtgaaggccgcgcatagaaggacacgtcgcggagaaaccccggggtacccacggcggcactccgcttccacaagccgtcccagggccgccttgcagagagggaccgccaacacccgctaggctcacgcccgccagaacccctccgcaccgatgacgccacagcaacagaggaagcaag

SEQ ID NO: 15400 - DNA, 770 bp, Homo sapiens
gcgcgatggcggcggctcctttaggcagctgaaaggggatttaggcccggaagatccgagtccatccgcggcggggagagggcaagcgggaccggtaggggccggagcagcggcggcggcgctcggactgtcccatccgccccgtattgaggcgctgggagcggcggggcgacaggaaagcgatggtgaaagcggggccgtgaggggggcggagccgggagccggacccgcagtagcggcagcagcggcgccgcctcccagagttcagacccaggaagcggccgggagggcaggagcgaatcgggccgccgccgccatggagctgagagtcgggaacaggtaccggctgggccggaagatcggcagcggctccttcggagacatctatctcggtacggacattgctgcaggagaagaggttgccatcaagcttgaatgtgtcaaaaccaaacaccctcagctccacattgagagcaaaatctacaagatgatgcagggaggagtgggcatccccaccatcagatggtgcggggcagagggggactacaacgtcatggtgatggagctgctggggccaagcctggaggacctcttcaacttctgctccaggaaattcagcctcaaaaccgtcctgctgcttgctgaccaaatgcaacgtgtgctccctcacctggtccgaactttcaagttctccttttagcttctctacaatctcttcgagatgcttcactgtgacccgggacttctggagctcctcctctgcggcgccc

SEQ ID NO: 15401 - DNA, 1263 bp, Homo sapiens
ttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtgtaagtttttaggtgtacttcaacttttagaactatgtatttttttatgaacaataaagattcctgtaaaatattcaagctacattattgtttaatgggtatagatcttcagttttacaaggtgaaaagagttacggagatgaatcgtggtggtggatgcataatgagatgaaggaaagtttttttctatttctagctttctaagaatgtcgtcatgctcaacacattgagtagatgttgagttttgacatttgagatggtattgatgactggcatatggtcttgagattgtatatggttcctaatgtctttttctttcccctcctaatgtcttaacgtagtgaattgtagattcactgtagatttcctcatgtcaagtcattcttgcattcacagaataaaccctacttagtcaaggtgtatttacaaaaatgcattattacatttgtcgtgctaatatttttattacaattttaatatctctataaataaatgggattgcttttaaaaattcaaactacaggatatgttgaatgaaaagtgatagtaatccttgtctgctccttccccgccatgccccatttgtacttacaggtaaccacattcttctgaagttttcggccttttgaacagtttaggttttctttctctttccagcataatgacataaaattgtacatggttttctgtcaatttta

SEQ ID NO: 15402 - DNA, 2537 bp, Homo sapiens
ttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaac

SEQ ID NO: 15403 - DNA, 4045 bp, Homo sapiens
caactgcctggcatgtgactggaggtactttgcagtcattgctgggatttcactgatgtgaccccaacgctgcctccctctccaccccacgatgttggaagaaactcaacagagtaaattggctgtggccaagaaaaagtcctcgagccgctgtgaagcagtcctcaagcggcagttatggcagtccataaaggctcgggcacagctggaagcacacgtgacacagatgttggaacaagtccagctagagacagatgaatatactcaacatctaaaaggagagagggcccggtggcagcagagggtatggaaaatgtcagaggagggccctgtcccccgtgctttgggcaggtttgcacatggaaggaggagaagaagcatgacaggcatcgggtacaggagctggagaggagcttggccgaactcaaaaactagatggctgaacccctgcccctggagcccccagcagggccctctgaggtggaacagcagctacaagctgaggccgagcacccgaggaaggagcaggagagtctggcaggacagctccaagctcaggtgcaaaacaatcaaggcttgagtcacctgaactgggagcaggaggagaggctgctggaacgggagacgctgcgggagcaggagaggctgcaggagctggaggagaagctgcaggagtaggagaggctgggagagcgggaggagagtctgcgggagcgggaggagagtctgcgggagcgggaggagaggctacgggagtgggaggagaggctgcggagcaggaggacaggctgctcgagctggggcggaaagccaagctctgggaggagcaggcagagacgtgcatgcaggccctgcggaaccacaccaccatcaaccacgtgctctctcagaaccatgagctcgactagcagctggctgggccacagagcggcttagaggagctgaacaacgagaataagagtgcactacagttggagcagcaagtaaaggagctgcaggagaagctgggcaagctgaaggagactgtaacctctgcccatccaagaagggctgggaggagcacctggaaggtaccagccagcagaaccagcagctacaggcccagttgagcctcatggcactccctaggcaaggtggcgtttttcaactccgctggagccagtgcccaggaggagcaggtatggcttatgtgggcagctgagggagcaaagggtgtggtgccagcgcctgactcacccgggtggccttggcccagaaggagccagaggtagtggaaccagccccagggactggggatgagtctgtgtgtgggtagactcatcaggccctgcagggatccatggagaagttgcaggtgagtgagtcatggcatgggccaagaaggttgggggcagagcagggcagggcaggtcgctctcaagatgtgaccccattattttggatccagagtggctttatggacctcctgaaggagaaggtggacctgaaggagtgggtggagaaactagagcttcgatccatccacctctcaggacaggcagacaccatcagaaagtaaatcacaacatacgagggccagagggcagcgccaaagacgcggcaccaggaggaggaggacatcatcaggctggcccaggacaaagaggagatgaagatggggcattgcagcacctctgtgggggtgggggtggggtgggtgtgagcgtgggcaggggcactggcaccagcgtggcagctgagcacccctcccttcaggtgaaactgctggagctgcaggagctggtgttgcggcttgcaggcgatcacaacgaggggcatggcaaattcctggccgctgcccagaaccctgctgatgatcctgctccaggggccccagcccctcaggagcttggggctgctgacaagcagggtggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttc

SEQ ID NO: 15404 - DNA, 2494 bp, Homo sapiens
agcggatctctgtaggggaacccaggtcgccgccgttgctgaggcagaagtgagatgtgtgatgtttgtttggggcgactcctgtgtacagtaatggagttgtttagacttccatgaaattcaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaac

SEQ ID NO: 15405 - DNA, 3207 bp, Homo sapiens
cgttgacgcggaccacaggacgacaggtggcagctgccacggaggacctggagagcaggtggcgtttttcaactccgctggagccagtgcccaggaggagcaggtatggcttatgtgggcagctgagggagcaaagggtgtggtgccagcgcctgactcacccgggtggccttggcccagaaggagccagaggtagtggaaccagccccagggactggggatgagtctgtgtgtgggtagactcatcaggccctgcagggatccatggagaagttgcaggtgagtgagtcatggcatgggccaagaaggttgggggcagagcagggcagggcaggtcgctctcaagatgtgaccccattattttggatccagagtggctttatggacctcctgaaggagaaggtggacctgaaggagtgggtggagaaactagagcttcgatccatccacctctcaggacaggcagacaccatcagaaagtaaatcacaacatacgagggccagagggcagcgccaaagacgcggcaccaggaggaggaggacatcatcaggctggcccaggacaaagaggagatgaagatggggcattgcagcacctctgtgggggtgggggtggggtgggtgtgagcgtgggcaggggcactggcaccagcgtggcagctgagcacccctcccttcaggtgaaactgctggagctgcaggagctggtgttgcggcttgcaggcgatcacaacgaggggcatggcaaattcctggccgctgcccagaaccctgctgatgatcctgctccaggggccccagcccctcaggagcttggggctgctgacaagcagggtggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaac

SEQ ID NO: 15406 - DNA, 2484 bp, Homo sapiens
ttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaac

SEQ ID NO: 15407 - DNA, 2219 bp, Homo sapiens
ttttgtatttttagtagagattgggtttctccatgttggtcaggctggtcgcgaaattccggcctcaggtgatccacctgccttggcctcccaaaatgttgggattacaggcgtgagccactgcgccaggctttgcatatttctaaggtaggtcttcaacgccaccaaatctttgaaagtaaaatggtaactttttatgcgacctgtactttttctctattttgttggttttgtttcggctagctagatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaac

SEQ ID NO: 15408 - DNA, 2483 bp, Homo sapiens
ttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctctgagatgcaaaatgaaagacgagaacaggcacagcggactgttttaatacattgcccagagaaaatcagtgaaaacaagtttcttaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtatagacgatcagctgaacactctcttgaaggagttccagctaacagaggagaacactaagctccgatatctcacctgttctcttattgaagacatggccgccgcgtattttccagactgcatagtcagaccctttggctcctcagtcaacacttttgggaagttaggatgtgatttggacatgtttttggatctagatgaaaccagaaacctcagcgctcacaagatctcaggaaattttctgatggaatttcaagtgaaaaatgttccttcagaaagaattgcaactcagaagatcctgtctgtgttaggagagtgccttgaccactttggccctggctgtgtgggtgtgcaaaaaatattaaatgcccggtgtccgctcgtgaggttctcacaccaggcctccggatttcagtgtgatttgactacgaacaataggattgccttgacaagttccgaactcctttatatatatggtgccctagactcaagagtgagagccttggtgttcagtgtacggtgctgggctcgagcacattcactaacaagtagtattcctggtgcatggattacaaatttctcccttacaatgatggtcatcttttttctccagagaagatcaccccctattcttccaacactagattccttaaaaaccctagcagatgcagaagataaatgtgtaatagaaggcaacaactgcacatttgttcgtgacttgagtagaattaaaccttcacagaacacagaaacattagaattactactgaaggaattttttgagtattttggcaattttgctttcgataaaaattccataaatattcgacagggaagggagcaaaacaaacctgattcttctcctctgtacattcagaatccatttgaaacttctctcaacataagcaaaaatgtaagtcaaagccagctgcaagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaac

SEQ ID NO: 15409 - DNA, 1068 bp, Homo sapiens
cgttgacgcggaccacaggacgacaggtggcagctgccacggaggacctggagagcaggtggcgtttttcaactccgctggagccagtgcccaggaggagcaggtatggcttatgtgggcagctgagggagcaaagggtgtggtgccagcgcctgactcacccgggtggccttggcccagaaggagccagaggtagtggaaccagccccagggactggggatgagtctgtgtgtgggtagactcatcaggccctgcagggatccatggagaagttgcaggtgagtgagtcatggcatgggccaagaaggttgggggcagagcagggcagggcaggtcgctctcaagatgtgaccccattattttggatccagagtggctttatggacctcctgaaggagaaggtggacctgaaggagtgggtggagaaactagagcttcgatccatccacctctcaggacaggcagacaccatcagaaagtaaatcacaacatacgagggccagagggcagcgccaaagacgcggcaccaggaggaggaggacatcatcaggctggcccaggacaaagaggagatgaagatggggcattgcagcacctctgtgggggtgggggtggggtgggtgtgagcgtgggcaggggcactggcaccagcgtggcagctgagcacccctcccttcaggtgaaactgctggagctgcaggagctggtgttgcggcttgcaggcgatcacaacgaggggcatggcaaattcctggccgctgcccagaaccctgctgatgatcctgctccaggggccccagcccctcaggagcttggggctgctgacaagcagggtgatttttgtgaggtgagccgacagcctggagcctgcaccaggagaggccagggagggttgtccccatgacaaccccactgcacagcagctcatgcagcttcttcctgtgatgcgggacccccaggagtacccaggcttgggcagcagtccctgcatgccattcttttaccaggctgccaagaacagggagctaaacatcaccatcatctaagagctggtcaagaaattaaaa

SEQ ID NO: 15410 - DNA, 152 bp, Homo sapiens
caggaaatctcttgagacccttaaggtcagaaacaagacagacaaatctagtcatccaaaacacacaattgcagtaattatagaagtgtgttgagatgaaattgtgaatatgattgtttggactgaggaatggtcagattgatagattcttt

SEQ ID NO: 15411 - DNA, 492 bp, Homo sapiens
ccccagaggagctcaacacagattagacttagcagaagaacaaataactaaatatgaagatagatcagttgagattgtccatgtgaggaacagaaagaaaaacaagcaaataaacataaacagagctagacatctgtagtacgcccccaatcacacaaacatatgcatcatgagagtttcagaagagaaaaaagaaagaggtagagagaatatttgaaaataactgatgtccctaatttttccaaacattaatcttcacagccaagaagctcaacaaactctaagttggataagttcaaagagagactcttcaaagcagcaagggaaagcaattgataagataccattaataatattaatagacattctcagaaaccatagaggcaagaatagagtagaatgacatgttcaaagagctaaacaaaattaatctcaatcagtatttccatatttcagcaaaagtatccatcaaaaatgaaaaaaaaaattatt

SEQ ID NO: 15412 - DNA, 478 bp, Homo sapiens
aaatttttatatatgatacacaaaatatatatagatgctcttctgcttgtaatggtgttatgtcctaataagcccatcataagttgaaagtatcataagttgaaaatgcatttaatacacctaacctactgaacatcatagtttagcctagcattccttagacatgctcagaatgcttatgttagcctaaagttgggcaaaattatctaacacaaagcctatttcataataaagtgttaaatatctcatggaaattattgaagtttctactgaaagtgaaaagcagaatggttgtatgggcacttgaagtttcagttgaatacattgctttcacactactatagagctgaaaaatagtaagtcaacctatcattggggactgtccatatatgaaacatacaacagacaaaagaaagggatttggttttcaaaattggaattcttatatattttttacatttattatgataaaaaattg

SEQ ID NO: 15413 - DNA, 522 bp, Homo sapiens
tccctattatttctgtccacattttataggctatggaattgaaacatagagaaattatttaatttgctcaaagtcccctagctaatagctgatggattcaggattcaaatttagacagtctgactgcagaacatactgttttaacagctacattgagttgcattttaacaaacaaatatttaacaaataaatattaaaatatttaattctggagttcttattctgttatttctggaccttggctactgctattggtagaacttccgtgtatcctgacagacatattgtcagtgccctcgcacactctcccagaggagacctctgggccccacttcagaaagccctggagtgtgcatgcaggtgtggctccttcctcctggagatcttacatagtacactgtgaaggaccatgagggacgtaagatgtataatgtacatcctacaccctcgaggtgtgcaacctggtgtccttgttggaatgtgaggagtttaccatgattaagagctcagatgctttcatta

SEQ ID NO: 15414 - DNA, 520 bp, Homo sapiens
agctgaggcattggtgtacccccagatcaccctgagtctgcttccagagccaggccctggtgaccgccataaagacccagcaaagagttctaggacagtgcttggctcagggtgcccacactcttgactccagtgccaggagtcctgcctttgtgctcagtttgtagggacctgcctagggagggcctctctgcctgagtgtgggtggaggtctctgtctgggcaggggagagtcattggctccgctcatctgggaggtgactgagaagttttcagattccctggcatctcagtgtcatcttgccatgcttggagatggggattcaaaatgaaattttacatcattttacatcctatgataaaagttggagccctgctcacaggccaggcactttataaagggggctacatacacccaagcagagaggaggaggctggcactgcccatgctctcataagctacttcctagagccctgtagatcctggggccaaacacctcagtttgaagtaatttccaaa

SEQ ID NO: 15415 - DNA, 451 bp, Homo sapiens
atgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagttt

SEQ ID NO: 15416 - DNA, 819 bp, Homo sapiens
ggagtttgtgtctagtctacaatgatgctatcctgtgtggattatgtgcttccttctttgctgtgagcaactgctcacttcactgttggttggagccagaatctcttctagaacagtttccaccatcctcaaggggagctgagatggggagggggaagttgagtcttccaattacattctctccttggtaaaatccttgttttccctgaaaaaacaaccccatctattctctcctcaagaagtgtttgaggaaaaggtataaaaaaggtactttaaaaattattttcttatagtattaccttcacacttctgctaggtctcctctagaaacaccagttctcacacattaaaactttaatccactcagggaacattttcctaggcatgactgtccctcataagttgctatagacaccagatcaatttctagccctccaattctaggagctagtgctacacagagtgggtgccatacctattattatgttactttttcttttggaagtgtagcctccaagtctttaagccagagtctgaaattaaaatgtccataggaccaggcacctgccataaagattgaagcacgtgaaagcacatggccatttgcttaacagaacctaggtcacatatgaaacccttttgccttgacaaaaaaattagctgggcatgatggctcacgcctgtagtctcagctacttgggaggctaaagtgggaggatcacctgagccctggagattgaggctgcattgagccacgatggtgccactgcactccagcctgggtgacaaagcaagaccctgtctcaaaataaataaata

SEQ ID NO: 15417 - DNA, 207 bp, Homo sapiens
acacccacacagacacacaggatgagtgctctatatagccaatgaagtcaagatcagttccctcattgcccagaagatgcagatacaaaatagttaattgagaagaaagaagattaccagcttgttcataaagtgctttgcttcatcattgatctttaaaatactagaaagaagttagtattgtttttatttttcccattgggtgat

SEQ ID NO: 15418 - DNA, 252 bp, Homo sapiens
accccctctaattgccaatctaaccattgcaacccagtacttatctctattaatacccttaccttcaccattcccacacccactgtagagcgattttatggctaaggggcagatgttgctggaagggaccctataggcttctttaaattatgctttgttccttccccttcgtctcccaccccctcctcgatcccacaaattcaaaccatttcccacctcatacccaacgacaaaaccaaagtatcgtaatag

SEQ ID NO: 15419 - DNA, 476 bp, Homo sapiens
agtttgggccagtgtgagccagctcccttcctagggtgccggctcagggagtcaggtaatggggccagggaaacgtgtgcccactgacttgggaaagagagaggggcccatacctccttcttggcaggaaagaaaatcacagccccgaaaaagtaacttgccaggagcccccttctttgtagcattcctatcactgacttcctgttagcctgggtctcctgttctcaccctgctctttgaaatccttggtggccagtgccggctatgtaggtgacctgtgctccctggtcccatggaggttctgcccagctgaccagccttgcagtctgtttctgcagcccagataatggttcagaggcatgttaatgtgtgctttgctttatgtagcaaatatcatcttgaaaagtttttttgtacatttactttttttttgtaaagcgacctacataataaaagcactaggggagctggttatt

SEQ ID NO: 15420 - DNA, 703 bp, Homo sapiens
atcctaaatgctttaaaaccccaaactttttgagtgcccacataatgatcaaaggaaatgctcattggagcatttagattttagagtttctgatttggtatgctcagttggtataatgtacatattccaaaatctgaataaatgtgaaacccgaaacacttttagtcccaagcatttcacataagggatacttaacagcctagtggtataaacttgaataacctttttaagggaccttttaaccatttcttgttgaattgaaaaatgatactcttaacaattctaaggaaatagtcactgtgcattaaagagctgcacaaagatattcatggcagcattttttgttgtcaactgtatataatatgaactgcataatgtaaacattataaacagaaatgtccatcagcaggtaaatggttcattcaattaatagtatatccatacagttaaatggaatgaaatagatccatatgtacagacccagaaatttttgcataatttagtaattatgaaaagttatacaggacagttgtgctagcttttgcctgtaatcccagcatactcggaggccaaggcagaaggactgcttgaggccaggagtttgacaccatcctgggcaacatggtgagaccctgtctccacacacacaaatttaaaaattaaccaggctcccagatcacagcatgttgaccaaaaaaaaaaa

SEQ ID NO: 15421 - DNA, 553 bp, Homo sapiens
ttttttttttaatttcacattccttttacttaattctgaacataaaagtcagaccagaagtaccccaaccttataaggatttaaaatatttataatacagaatcatgatgtaacatgtttcatgtccttgttagtgagcaggtgattataatactgtgacaaaagcatgcttaagacacttctaattattatcattattattattattgagacagggccttgctctgtcatccaggctggagtgcagtggccaatcttggctcactgcagccttgaccacccagggctcaagccattctgccatctcagactcccgagtagctgggattacaggcgtgcaccgccaggcccagctaattctttttgttttttagtagagacaagtttcaccatgttgcccaagctggtcttgaactcctgccctcaagtcatcctcccgccttggcctccgaaagtgctgggattacaggcatgacccaccgaacccggccggcacttctagttatttcacagttggtagagatggagaacttcggatttgtataaaaggcct

SEQ ID NO: 15422 - DNA, 446 bp, Homo sapiens
gaggaatatttgtccaacagcataaaatgaaggtagggactccactgtttgtaatttgaacttcacacaattttccttattctagcactgaatttcactcttctttcctcgcctttccaataaggcggctgtgcctaaatctagctttccatggataccaaggtcacaacctggatagttttctctaccactccaaaatgtggctggtggctgaaatccagactgcctgctggtaagccatctttgattctcctgtgaaaaatgttcatctctatcaaccgtgggatggggtccttgaatggtgaccccacactgggtgtctaatagagcactttgactttccatgcctctttgtgtaatcaagggaggcattgggaaatgcatgcttttcttttttgtgaacacataccttgtaagttttgccattaaaatctgttcattaactc

SEQ ID NO: 15423 - DNA, 568 bp, Homo sapiens
gtaatagtatatgatagcatagtatatgatagcagtagtatacgatagcatgtgtgtgagtccattttgtattgccataaaggagtacctgaagctgggtaattaataaagaaaaggggtttatttggctcactgttctgtaggctgtacaagcatggcactaacatctgcttggcatgagccaccacacccggccagaattttatttttagtgactaggctttcctttaaaacctctgtactaggccgggtgcagtggctcgcgcctgtaatcccagcactttgggaggctgaggtgggaggatcacttgagcccaggagtttgagaccagcctgggcaacagagtgaaaccccatctctttaaaaaaataaagcacttgaagcagaactttttatctgtcataatcactgctatgtccacagcacctaaaacagtcccagacatctgttgaataaatgaatgaatgaggtgggaagtctttctttacacttagatgaaaactccatcggaccccaaattgttctggtcttgttcaggtaataattttaattctataataaaatctc

SEQ ID NO: 15424 - DNA, 465 bp, Homo sapiens
aacctaaatcccctttaaattcactacagaacaaagagggagggccagtctagagcctggactcctctcagggcaacccagcagatagtcacattcaacccaggccaagtctagtgtctgggacattctggtttgctcaggcctccaggcaggcttaattgggaaggccaagtcagattaaccctcagtaatttttatacatgccctatacttggtaagaaaatgtaccctctgcaccaaggcttgcctatgcattgtcggcttaataagacctgccttgcttgtaagacattatattttcattgatgttttgaccttagaacatgagaaagcacatgaacatatagcaaaactgaatcttagggtcaggaaagttcttccagcatggcacatgtatacatatgtaactaacctgcacaatgtgcacatgtaccctaaaacttaaagtataataaaaaaaaaaca

SEQ ID NO: 15425 - DNA, 1247 bp, Homo sapiens
ggaggtttccctctgaaggaatctagaccattttttaatatggagaataactgtaccccatgttagaagtgctctttagccatatttcaagatccagatctgaacccatactgtgcagaaaagcacaagagcgcttacagccaagagccctgggaggagttgagtaacaggctgagatccggtcaccaagcatcattagttagcactgaaattctcccaggacacaaaacaaatgtatggaaacatcgcaatacactatcatttactcacatgggacaaccacctaagtccatagcaaaactttacagatctagatgttatctcaagtcaggattccagatcaacatcctccatgtggagatgagacaactgaggttcagaaagttggagtgacttatttgcccagctagctaactggaattagagtctgggtctcccaaccactgattctgctacaccacactgtgctgcttccattagttagatggacattgacaattaattgtgaaagcattaattaggaagtcaagacaaaagaatgtttgtgatatcttctctcgcttaacatactttgatttcaccattgcatttcagcattttaaagaatagtgtatcagtatagaaggaggagcaaagctctttaagagtaatgatgaaaccaaaaggtcaaaaagtagaagaatagcgaatgtaagttattaaataaatgagcaagaagtatgtgtcagggaaaataaatgcttcttatattgttaataccgtgattccctgcccgctcaccccgtcactcaacacttgatgcatttgttttggaaagtgccattttatgctgagatactggtattgaaaacttccctctttcccaactctgtcagaagttctcttgctctttggaagaagccgagggccttaacaaatcagactgacctcccttgtgacaggcagcctcgcctgcccttggaaacaagctgccagaatgtgagggccacagagacccaagagaagccagcactgctagactgaggaacttgtaaatatcttctgctttcttggtgaacaaggacagaggcaattgcgtgtatattgtgactgtagtttgtgaagaaaatgcaaccatttgcttcgacagctcctcaaatgtacttgttaagtgtgaatgtgcctgcctcattgccttgtgttccaaacacagtactgaatgcgttgtttttaaataaaccatttcgttttgctttgaaaaaaaaaaa

SEQ ID NO: 15426 - DNA, 1132 bp, Homo sapiens
acatacacatcaggaggtggccttgagaagctgagcggagaccggctagactttactcaatttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttaaaaaaaaaaaaaaaaaaaaaaaaaaaaaaaaaaaaaaaaaaaaaaaaaacaaagaaaaagagataaaaagagaaaggggagagactataaaataattttcagggaagaaagaaagagaaagagaaaccattatctgaaaagtgcatccacatacgagaattaaaaagacaagggaggaaattataaaaagtataagatagcaaagaatggattagaagagaaacataaggtagagaaaaagagaagaagaagaaagatgacggtgagataaaagagtgtaggtgaaaataatggcagagggagaagcgtgtatgaaatgaacaggaagaa

SEQ ID NO: 15427 - DNA, 1240 bp, Homo sapiens
acatacacatcaggaggtggccttgagaagctgagcggagaccggctagactttactcaaagaaaccaagagactgttaccatggcagggaagcccaagcttcactacttcaatggacggggcagaatggagcccatccggtggctcttggctgcagctggagtggagtttgaagagaaatttataggatctgcagaagatttgggaaagttaagaaatgatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttaaaaaaaaaaaaaaaaaaaaaaaaaaaaaaaaaaaaaaaaaaaaaaaaaacaaagaaaaagagataaaaagagaaaggggagagactataaaataattttcagggaagaaagaaagagaaagagaaaccattatctgaaaagtgcatccacatacgagaattaaaaagacaagggaggaaattataaaaagtataagatagcaaagaatggattagaagagaaacataaggtagagaaaaagagaagaagaagaaagatgacggtgagataaaagagtgtaggtgaaaataatggcagagggagaagcgtgtatgaaatgaacaggaagaa

SEQ ID NO: 15428 - DNA, 1138 bp, Homo sapiens
acatacacatcaggaggtggccttgagaagctgagcggagaccggctagactttactcaaagaaaccaagagactgttaccatggcagggaagcccaagcttcactacttcaatggacggggcagaatggagcccatccggtggctcttggctgcagctggagtggagatgggagtttgatgttccagcaagtaccaatggttgagattgatgggatgaagttggtacagaccagagccattctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaaggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgctaacttaaaaaaaaaaaaaaaaaaaaaaaaaaaaaaaaaaaaaaaaaaaaaaaaaacaaagaaaaagagataaaaagagaaaggggagagactataaaataattttcagggaagaaagaaagagaaagagaaaccattatctgaaaagtgcatccacatacgagaattaaaaagacaagggaggaaattataaaaagtataagatagcaaagaatggattagaagagaaacataaggtagagaaaaagagaagaagaagaaagatgacggtgagataaaagagtgtaggtgaaaataatggcagagggagaagcgtgtatgaaatgaacaggaagaa

SEQ ID NO: 15429 - DNA, 580 bp, Homo sapiens
agccttcgtgcagcctgtttgcccagcattgtgggtggcgtggctaattctgagccacagctgctctgtctttttcttcagggggtgaggccctgggatgggggcggatgggcacaaagagcctctgtggcctgtgaatggagcagcgccgtgtcgtggccgcgccgcgtgggcgcgaagccgcttgctcgatgtcttgcctccacgagcatccagtgaatctccttcctcccacctgagcctcagtgctctttccgcagggcttagctccatcatcactgctttgacgggattagcccagagaactttgagctcccgtagaccactccataggaccatgtgcccacccagctgtcagaaagacttgtcctaatgacccgtggtccccttctgctgtcagcaccagctgtttccaaacatctggctccatggcactcccttagtgtgcgaccacgtgtccttggttttcctgggctggatttcctagagtgtgggttttctcaaagtccaggaacaaagcttgattgtttctgagctcctggggtgaccttgctgctccctggccttctctcttgtcccc

SEQ ID NO: 15430 - DNA, 428 bp, Homo sapiens
aaatttcacagaggactatgcatggtagtgagtcagttgtgtatatgtgtgtgtgaaatgtgtttctttaccgatataaaagtttgaaagtcactgctttagagagtttctgttggaacaagcttccaagcaacccatatgtctgtactagaggaaaatctaggaatatcactgtaaggaaacatagggtcgtgtatgggaagatatggactcaaagagtttgtagagcaaggaaatcacagctgcttagcatgggagagtttgccaggataaatgatgatgatatgttgacagtgattatgttaatcatgctaattatgataaaaatgaaacttttttcaactcatgcattttcaccttttgacatttctgaagtagggaatattttaagatttagtggcaagtcatagtttttacttcatattttc

SEQ ID NO: 15431 - DNA, 370 bp, Homo sapiens
gaaataataagaaactgtaatattataagtacatagttcagcttcattatgggttaaaagaagggtttgtgggctggcatgagaatacaccagtttataacattgtatacttgggaaaatttcattctgaagtctaaactgctattttttagaagaaactgttagagcaccctgggatgtgtgggcctgggactgtttgcctttggcacggctatgctccgagctttggaggagccaaggaagaaaggcctagttcctgatcttaaggcctttgcagtgtgcattgggagacatagactgcaatgaaaagatcattattgcaagagacaaatggcatggagccacattcccaggtaacattttagtacat

SEQ ID NO: 15432 - DNA, 1262 bp, Homo sapiens
tgtgctcgtctgtaaaattagggatggggaaagaagtctaataaaaaggctcagagaaaggagatgctggagttgatgtaacaggattcaagactctacgatattaactgtttcaagtagaaaaccatcaagaaaggatagaaatttaggattgctttcaaggagcctctcattccagatttactacttagtactgtgtgaccttgggcaagtgactgtacctctctgggcctcagatgcctcatcttggaaatagattatcgtggtactcactttgtagtcttgttgtgaagagtaaatgaggtaattcttttttttttttttttttccagatgcagtctcatgcactccagcctggtgacagagtgagactccatctcaaaaaaaaaaaaaaaaaaaatcatacaatagtggaaaaaccacataacccaatttaaaaatgggcaaaagacctgaataggcatttctacagagaatatgcaaaaatggcccacaggtatatgaaaaggtgctcaacatcattcatcattaattaattattaatcaaaaccagatgagataccaccttacacccatttggatggcaactatcaagtcacaagataacaaatgttggtgagggtatgaagaaaagagaacccttgtacattgttgctgggaatgtagattggtccagctgttatgtaaaatagtatggatattcctaaggaaattaaaaataaaattaccagatgacctaacaatctctcttctgggcacatacccaaaggaaatgaaatcaccgcctcataaagagacctgcatgcctgtgttcactgcagcgttgtgacagtgaacataggcaacaacctaagtgtccggtgacagacaaatgaatacactgtggtatatgtctagattggaatattattcagccctaaaaaagatcttgcctttgccacaacatagacgagcctggagtgcactgtgttaagtgaaataaaccagacaaagaaagaaaaagattgcattgtttcaagtatatgtggaatctaaaaacaaacaaacaaacaaaaacccaactgtacagaaatagagaacaaaacagtgattaccaggcaggggatagctagggaggagatgggagatggaggtctgtattaagtagggagggtggccaggtctggagacctaatgtacaaccggaagactatgggtaagaaaactgtgctatatttgggattcatgctacaggagtagatttcagctgctcttgccaccaa

SEQ ID NO: 15433 - DNA, 1811 bp, Homo sapiens
aaaaaaaaaaaaaatcataggaaatgtttaaaaatcctgaggcttgggtcccatgaactgagatttttatttatttgatctagcgtctagctgggccttatgacttttagaaacactccaggtgattccaaggcaccacttggccagtggaaggccatgttaattttatattgaaaaagacctagaatataaatggtttactagtcaactaattttccacaagggcaccaagaggacacaatgggaaaaggatagtctgttcaataaatggtgctgagaaaactgaatttccacatgtaaaagaacgaaattggacccttaacttataccactcacaaaaaatagactcaaaatggataaaagacctacatgtaagatctgaaaccataaaactcctagaagagaacacggggaaaaagctcctggacaattgattggccttgacaggttttttttggatattgcaccaaaggctcaggacacaaaagcaaaagcaaataaatgagagcacatcaaactaaaaagtgtctgcatagcaaaggaaataatcaacaaaatgaaacagcttatgggttgggaaaaaaatatttacaagccatatatatggtaaagggttaatatcccaaattcataaagaactcatacaaaaggctgggtgtggtggctcacgcctgtaatcccagcactttgggaggctgaggcaggtggatcacaaggtcaagagatcaagaccatcctggccaacatggtgaaaacccgtctctactaaaaatacaaaaaattagccgggcgtggtggtggacacctgtagtcccagctactcgggaggctgaggcaggagaatcacttgaacccgggaggtggaggttgcagtgagccgagattgtgccactgcactccagcctggtgacagagtgagactccatctcaaaaaaaaaaaaaaaaaaaatcatacaatagtggaaaaaccacataacccaatttaaaaatgggcaaaagacctgaataggcatttctacagagaatatgcaaaaatggcccacaggtatatgaaaaggtgctcaacatcattcatcattaattaattattaatcaaaaccagatgagataccaccttacacccatttggatggcaactatcaagtcacaagataacaaatgttggtgagggtatgaagaaaagagaacccttgtacattgttgctgggaatgtagattggtccagctgttatgtaaaatagtatggatattcctaaggaaattaaaaataaaattaccagatgacctaacaatctctcttctgggcacatacccaaaggaaatgaaatcaccgcctcataaagagacctgcatgcctgtgttcactgcagcgttgtgacagtgaacataggcaacaacctaagtgtccggtgacagacaaatgaatacactgtggtatatgtctagattggaatattattcagccctaaaaaagatcttgcctttgccacaacatagacgagcctggagtgcactgtgttaagtgaaataaaccagacaaagaaagaaaaagattgcattgtttcaagtatatgtggaatctaaaaacaaacaaacaaacaaaaacccaactgtacagaaatagagaacaaaacagtgattaccaggcaggggatagctagggaggagatgggagatggaggtctgtattaagtagggagggtggccaggtctggagacctaatgtacaaccggaagactatgggtaagaaaactgtgctatatttgggattcatgctacaggagtagatttcagctgctcttgccaccaa

SEQ ID NO: 15434 - DNA, 522 bp, Homo sapiens
tctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcgtatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaaaaaaaaa

SEQ ID NO: 15435 - DNA, 342 bp, Homo sapiens
tctgcctgttgtctccagcacagcttcctattgaaagcaactctatgtctaacctgccttaaagcaggttacggctatattttaaaacccaccgcattaattcaggacatatctttttatcaaatggatttctcttctgcatacatatttaaacatgagccgtacactcagagcaatggactgttttatgaaaggtgattagcatatagtactcaatcaaagaatttgtaaatgaaaaaagttgaaaatatgaaatattgatcactggggtactcattaactgttcaaaagcataatttagttgaatttcaaatgtgttaatgtaggatatcattcatagaa

SEQ ID NO: 15436 - DNA, 2633 bp, Homo sapiens
gaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagattttttacaaagtaaggagaaaagagaaaaactaaatagtgaattgaaaatgaataaagtaaacttagaatttttacccaagtgtagacttaaatgttgctttgagtatggctggatcttgggagaattccagggaaatattaggtattagaaaatgactttgattgcatttcagcaggtgtctttattctgagtagtatcttaggagacaaactgtctcaagcaagaaacaataaatttttaaatattatgacagttcagggcttaaggcagtttagaagtattttgctacttgaccttgattttcagttattttaactttgaatttttttttttttttttgagacggagtcttgctctgttgcccaggctggagtacaatggcaccatctcagctcactgcaagctccacctccagggttcatgccattctcctgcctcagcctcccgagtagctgggattataggcgccagccaccacgactggctaattttttgtatttttagtagagacggggtttcaccatgttagccagggtggtctcgatctcctgacctggtgatacacccacctcggcctcccaaagtgctgggattaaaggcgtgagccacccgtgcctggccttgaatttttttttaacctgttatatagtctcctgaatagttagccatggtgccttgatttaatcttatgtcattgttctcaaatgccatgatttctctttaatagtagttgtcattatgtaagggtaagttattgcccatttaattgtaattataagaagaggtgccagctagtgaccttacatcagtgatcttttaagttctgaagggttctgcagaaaagttacacttcttgagtttgggttgcccatcagagctggtcacatttctttgatcattgaaaaaatgaatatcttaatttttgtctttgctgactggtatttataaaatacaaatgcttttagtgggttgagctgttgtgataatctcttccatctaccttagagaagaagctgtactatttagacagttttggccaacactagaagcaaaagaattcaaaggctgggtggatatttaagaacttattctaacctgtcaggtttcaatttgtggggcttggtttaacagaggaaaaaaatataaattgattttctgatgtctcacaaatatcacatacctggaaaaaaattaaaacaaaaaatgaattttgtaaaaggttatgtatgacttccatttgctctgtaaaaaaatgaacaaagattgtgaaaggatcctcttccaccacatcatttaatgggttagcggaacagatagggagctatgacactagcaccaaagagagatttttcttctggttgggtggtgctggtgccacgcccctttctgggatttgacaagtctttcccactcacctatacaatatgccaaatcaactggagttgtcattctaatgttttaaagaatgattgggttcccccaaactgtaggaggtcgatggtaacaataaagtgatacaaaatgcttatgtcattataatttatgtaagggagaccattaggctgagaatcaatatgattgaggttatctattctcctgaaaagtgaattggagaataaagaaagaatatttgaaaggatgttgtgtactaggcaatatactagcatgtattagaaaatacggtaaactgtgggttagaagagtgaaagtagctggtatgatagagcactggactgagtaacgaagagattctagtcatggctcttgtggtcatttcatttttgagcctcacattcttccaattaatgagggtaccagattaaataaactctggggattcatcccaattcgaactctgtaattctctgaatgaactctctcttcaattaaagccaaattattaacattttaactcaagtttaaatttaatagagaagtcaaaatgaggtatgcactttgtggaatgtttttggtcttatcacaataacctgattaaaatggtgcctttatttccatgtttactcctttaaataagatgaaagctttcagaacatttatttgcaaaatgactgtcaatatcaacaatatgcatcaaagtaccatatatgctaagggagaggagcacttgatgggctgctatgttaactgtaaattgagaactgcttgttttatggcttttgctgttaaaaaaaaactgctggcttttaatatgtactttaaaatatactcatgtctgggagactcagaaaaaaacaacaaaaacaacaaaacaccattgtggcccacatgggccctaaaaaacgtttgaaaacaatgtcgtgaggcccggggcccatgaggtaagcggacacggccaagaggcgcccagagaaacggggcacaacaaggcgggatctccgcataa

SEQ ID NO: 15437 - DNA, 839 bp, Homo sapiens
agagataaaagagaattctaaggtataatagagatagtaactgcagaaaaagattgctgtacctaaggctgagggaaaagtgaaaaaggaaggaacttagagctccacaaggctgagattcagacctcagaggagagtatggctgctgtggcagtatgctgcttgttgctgtggtgaagaagaaactggctggagggcactcacctcagaacctggagagtcgctgctttgaaatgtaccaagattcccctgcacactgatctacttgctactttgtgaaaaactgagcattgcaactggctttgtattctccttccagcaccctctatcggcagaacctaatagccactcgctccactgggaaaggagaaatgtagtcagcctaggttagtctcgtatcacagagcaaggcaatgaagaattggtttggaactgtaaggcaataatttaacttctgtattataattgtctgtttttgatatgtcttccttattgcaccatgaacttggtagtgtctggaacagtctgatttgtctccatatctgcattgtcccagaagtgactttggcactaaaaagttgatcattaattactgtttgggccaggtgtggtggctcatgcctgtaatcctggcactttgggaggctgaggtggatgtatcacctgaggtcaggaattcgataccagcctgacaaacatggtgaaacctgtctctactaaaaatacaaaaattagctgggtgtggtgccgggcgcctgtaatcccagctactctggagactgaggcagaagaattgcttgaacccaggaggtggaggtttcagtgagctgcgattgctc

SEQ ID NO: 15438 - DNA, 378 bp, Homo sapiens
gagcccagagctgaacagggaccctttcacttcaaggcaggcacctttcatccccaacagcagagggcactgcagcctccccctggccacccggtgtgtcccagagccacagctctctagccctgagttcatgcaggtgactgtcacttccgcaagagtcctcctacctcccagctggccacactcccagctgccgtcccagcccacagatgggccaatgcagtcgagatggcagtgtctgcccaacccatgtcccccagcccgaccccatgtctgggagaggccatgtagccccttggcacccacccggttccctccactggccactgcctgcgtcagccctgcctcacagcctcaaaggcaggcctgccctcctgg

SEQ ID NO: 15439 - DNA, 331 bp, Homo sapiens
tgcatttgggcattactccagaattcccctcacccctatcagactttcaaaaatgtctaaaacataatggctaagagttctataaaaaggtctctggacagcaatgtgaccagccaaactccaggagttctattatagaagggaaaggggtcattcatgtttttgtgagcaactagtagtttctgccattgtttctgatgcacatttttctttttcattgtcttagaggcttacattgttctctgtggaataagggataaccagattaattaatacatttttcccatctgcactgataatattgcattttgcctctaaaagaaactgagaa

SEQ ID NO: 15440 - DNA, 381 bp, Homo sapiens
aaatagagactgagtcttaactatgttgcccaggctggtctcgaactcctggcctcaagtgatgctctcaccttggcctcccagggtgctgggattataggcgtgagccactgcaccaggcctcaaagtgatttttttatatgggttatatatgatatacatgtgcagatcttttgacccagctatcccatgtcgtagatttatatgcatatacatgtccaaaaatataaaaatacatatgtacaaggtgacttataacattattcgtaattgcaaaattttgaaaacctaattgcctataggtgggagagtgcttaaattcaccatggtgaatctacacaaaggagactggcagttttaaaaaagaaatgaaacgtgagc

SEQ ID NO: 15441 - DNA, 327 bp, Homo sapiens
gccaagaggaataattagactgttgcaacaattatgacaaaggcgtcctatacccttggtcttctttcatccatagggcatccaaaagagacctggtttctctgttgattggaagttcacatcaaattccttgaccctgggattaaacctacagtaaacatgtgtatttttgtgttgcagatgcgtatcatagatggatagtaatgaataccatttattgagcatttatcatgtgcgaagtactctgctttcttcttcacaggtagatttaatcatctccccaaccctttgaggtagggaatactgtgatccttgttgtatattttt

SEQ ID NO: 15442 - DNA, 761 bp, Homo sapiens
ggatgtgaagaggcaaggcagaaatggatgatgaacatcaaaaactgtcagaggacaggtctgtgccaggtaccaggaaggacaagataagtccaagccccggctggcctgctctcacgtgtctgtgtaagatcatgcaagagaaatcacagtgccttctacagaattttcgtctttacctatgtgaagcgaggtgacgtgatacgtcactggcgccgtcttataatttagatgtaaaaatctttagaaacaaataaaactctctatatatgtgtatgtctgtgtacaaaaaaatgacagagctgatggccagtgtatacagagcgtggcccgcggtgtacaatacccatataaggtacattgtgcaggaggggaattgctggctgcttttacttcctgaccaagactgaaaaattatttactgaaatctgtaaacctttttatgaaacttttaagcaccaggctgtttacttacacaatttaggtctgccagaaaattctatctgtgatagatctgtaaagagggtcaggggttagagtttactatttttgaagtttacattgttacatatgaaatggaaacattattttgaaacgttgtcataacccaatggtgcattctgtaaccatggagtcttctgtttcctgggggaaaggggcattcatgacctgaactttttagcaaattattattctcagtttccattacctgtttggccaaacagattaataaaatatttgaaaaagaagcgttcaaaaat

SEQ ID NO: 15443 - DNA, 851 bp, Homo sapiens
atatgagaaaattagtggggaaaatagtactttctgttatctgtgtgtcatgatagttttaccagggacttttggtttatattacttcttatatttcagtgtccttttaggatacacacacacacttacacaatggaaatacaatatatatggtgaactcatttacaatacgcgattaccagttttccatgttagtttttctacccttacctgatcatttttacgactacttaaaatttctctgctggatcaacaatattttatctacatcctatcaatggctcacttttaggtagcttcccatatttttactcttacaaatgaacattatggaggaacacctttgagcatatacctttctacacttgtccaagttttctctctctctcccccccttttttttttttcacctgcagacacagggcaaccaagttgtcgtcttcaaattaatttctcagagtctactctctggataataggggtgagtttattttcagttctaatgaaactgactccaggaggtctgtatggatttcattcccattcaaagtttggaaatgtgacggctgggtggggtggctcatgcctctaatcccagcactttgggaggccaaggcaggcagatcacgaggtcaggagatcgagaccatcctggctaacatggtgaaaccccgtctctactaaaaaaaaaaaaaaaaaaaaatcagctgggtgtggtggtgggcacctatagtcccagctactcaggaggctgaggcaggagaatggtgtgaaccggagaggtggagcttgcagtgagccgagatcgcgccgctccactccagcctgggctacagagggagactccgtct

SEQ ID NO: 15444 - DNA, 659 bp, Homo sapiens
catgataaaatatttcttaaacattttagtttctaaattttctacagacattgaacaatttaaaaataattacccttcactttcttaatgttggcttatatcactaggctcactttaattgaggtgctcatcattttataatagctagtcatggaagattattaagatattttcttggttcatgtgctcttacaaatctaagtatatagtttacctttttacaggaacaatggaaactattgcttttttcactttatgaacaacatatcaacaggatagtctttctcatttctgggagatatactttaacatttgtctatgggaatatttttttttaagttttcaaattacttcaagcttttaagtaattttggctgggtgcggtggctcacgtctgtaatcccagcactttgggaggccaaggcaggcagatcacgaggtcaggagatcgagaccatcctggctaacatggtgaaaccccgtctctactaaaaaaaaaaaaaaaaaaaaatcagctgggtgtggtggtgggcacctatagtcccagctactcaggaggctgaggcaggagaatggtgtgaaccggagaggtggagcttgcagtgagccgagatcgcgccgctccactccagcctgggctacagagggagactccgtct

SEQ ID NO: 15445 - DNA, 383 bp, Homo sapiens
aaaatctgcctctactaaaaatacaaaaaattagccgggtgttggggcaggtgcctgtaatcccagttacttgggaggctgaggcaggagaattgcttgaacaccggaggcaaaggttgcagtgagccgagatggcaccatttcactccagcctgggcaacaagcgtgaaactcagtctttaaaaaaaaaaagaaaaagaaaaaccacagacaacctaaggaagaaaatcactgagaatgaattcaagaaagtttcccagaaattaaggacaagagttcactcggaaaggggcctggcatggaaacagaccttcgccaaggcaggtattaatacgtcattctgaaattttggaacactgataacagaagggaaaaaaaaaaaa

SEQ ID NO: 15446 - DNA, 350 bp, Homo sapiens
tgagatggggtcccactctgtcacccaggtgggagtgcagtggtgcaatgttggctcactgcagcctccatttccaaggttcaagcaaccctcccacctcagcctcccaagtagctggaccccagacatgcaccaccacacccagctaattttttgcattttttggtagagacagggtttcaccatgttgcccaggctggtctcaaactcctgagctcaggcaatccacctgccttagcctcccaaagtgctggggttacaggcaggagccaccatgccaagtggcttttaaaagttcaacttttaaaagattccacatgtgaaatcacgcagttcagcaaatatttatt

SEQ ID NO: 15447 - DNA, 2326 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15448 - DNA, 2584 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15449 - DNA, 3735 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgttgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaacattttgtagcacttgagattgtcttatacctaaggtattacatatttggtatataattaagccttataaaacttggtaattgattaagttttaccataatttttcatcctattctgtagtttctaagataagcacagctaccacctctaaatctgcagcagaatgctggccccagggttattaattcacattaccaaaagcatttttagggaactttttataaagaaagaataattgtttgttaggcttcatgtcacttgagtgagtttggcagtgtaacaggatggttcgtacacttactacttttctgtgccgtgcatcatatgcttctggacagtttccaaaggcctccggaaaagtaggcgaggcctgctttttatggcaacttggcatccatagaaaattttaaaattggtgaaggttgcaatactccaaataatgtaaaatgactgccaggctacaatataaagtgagttcagttaatc

SEQ ID NO: 15450 - DNA, 2683 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgctggagtgcaatggtgtaatcttggctcaccacaacctctgcctcccgggttcaagcgattctcctgcctcagcctcccgagtagctacagattacaggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15451 - DNA, 3249 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgttgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaa

SEQ ID NO: 15452 - DNA, 2964 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggcaagcgcgaaggggctgacttggtggcgagccagcccgccttgtgtcggagaagggttcttcgggcaactttcctttccgggtgttctgaagcggttttcctgtaatcctcagtgaggaaacccaccgtgaatcggattgccgttcagtcccacggaagcctggctcgttggccatgtcggggacgcatgttcattaagttcattaaaataatttcatttgtcttggctggagctactcggccagggtttaagactttaaatgagaataaagggtggtatttacgaggaaatgagagtgaataagtcatctctaacctctcccagcctttttttcataagagagaccatattaaacttacatgggtcgtgattccaaattcttcagcagaaggctgagattggcagagatgaggaggcctggattatagttctgcttctgctacctcagctgtgtgacgtgttacttaacatctctggacttgggccaggctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15453 - DNA, 2512 bp, Homo sapiens
gaataagcagaaaatcataagactctttttatagtgtttaaaacgtcagtaggttatttttggaatttttaattctcttagtcgtggagtccttgaggataggccctttgatcatctttacaacttcagtgcctggcagataatagctgctcagtgtttgttgagcaatggtcacagttcggattactcccgagtccccctaagtaaactgggcaggtgaaccacatggagcttgggaacctagttgaagtgaaatttagaaaattttactgtttatctgtctttaatactggccctgcctcatggctaattcttaagaagaaaaaatatctctgttgcaggctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15454 - DNA, 2352 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15455 - DNA, 2462 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15456 - DNA, 2488 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggctggagctactcggccagggtttaagactttaaatgagaataaagggtggtatttacgaggaaatgagagtgaataagtcatctctaacctctcccagcctttttttcataagagagaccatattaaacttacatgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatga

SEQ ID NO: 15457 - DNA, 3681 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgttgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaacattttgtagcacttgagattgtcttatacctaaggtattacatatttggtatataattaagccttataaaacttggtaattgattaagttttaccataatttttcatcctattctgtagtttctaagataagcacagctaccacctctaaatctgcagcagaatgctggccccagggttattaattcacattaccaaaagcatttttagggaactttttataaagaaagaataattgtttgttaggcttcatgtcacttgagtgagtttggcagtgtaacaggatggttcgtacacttactacttttctgtgccgtgcatcatatgcttctggacagtttccaaaggcctccggaaaagtaggcgaggcctgctttttatggcaacttggcatccatagaaaattttaaaattggtgaaggttgcaatactccaaataatgtaaaatgactgccaggctacaatataaagtgagttcagttaatc

SEQ ID NO: 15458 - DNA, 2145 bp, Homo sapiens
ccacgcgtccgccacgcgtccggaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgttgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaacattttgtagcacttgagattgtcttatacctaaggtattacatatttggtatataattaagccttataaaacttggtaattgattaagttttaccataatttttcatcctattctgtagtttctaagataagcacagctaccacctctaaatctgcagcagaatgctggccccagggttattaattcacattaccaaaagcatttttagggaactttttataaagaaagaataattgtttgttaggcttcatgtcacttgagtgagtttggcagtgtaacaggatggttcgtacacttactacttttctgtgccgtgcatcatatgcttctggacagtttccaaaggcctccggaaaagtaggcgaggcctgctttttatggcaacttggcatccatagaaaattttaaaattggtgaaggttgcaatactccaaataatgtaaaatgactgccaggctacaatataaagtgagttcagttaatc

SEQ ID NO: 15459 - DNA, 1160 bp, Homo sapiens
taacattttcccccaggaaacaagctattacattgatacgaatttaatcggcctccccataaggaatttggccctcagggcccagaattgggcccgagctcctttgggccactacatattttggtttctagaaaatgttgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaacattttgtagcacttgagattgtcttatacctaaggtattacatatttggtatataattaagccttataaaacttggtaattgattaagttttaccataatttttcatcctattctgtagtttctaagataagcacagctaccacctctaaatctgcagcagaatgctggccccagggttattaattcacattaccaaaagcatttttagggaactttttataaagaaagaataattgtttgttaggcttcatgtcacttgagtgagtttggcagtgtaacaggatggttcgtacacttactacttttctgtgccgtgcatcatatgcttctggacagtttccaaaggcctccggaaaagtaggcgaggcctgctttttatggcaacttggcatccatagaaaattttaaaattggtgaaggttgcaatactccaaataatgtaaaatgactgccaggctacaatataaagtgagttcagttaatc

SEQ ID NO: 15460 - DNA, 913 bp, Homo sapiens
catttagccgcgcctaggttttctggatcggcctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggcaagcgcgaaggggctgacttggtggcgagccagcccgccttgtgtcggagaagggttcttcgggcaactttcctttccgggtgttctgaagcggttttcctgtaatcctcagtgaggaaacccaccgtgaatcggattgccgttcagtcccacggaagcctggctcgttggccatgtcggggacgcatgttcattaagttcattaaaataatttcatttgtcttggctggagctactcggccagggtttaagactttaaatgagaataaagggtggtatttacgaggaaatgagagtgaataagtcatctctaacctctcccagcctttttttcataagagagaccatattaaacttacatgggtcgtgattccaaattcttcagcagaaggctgagattggcagagatgaggaggcctggattatagttctgcttctgctacctcagctgtgtgacgtgttacttaacatctctggacttgggccaggtgcggtggctcacgcctgtaatcccagcactttaggaggccaaggctgttggatcacgaggtcaggagatcgagaccatcctggctaacatggtgaaacccccgtctctactaaaaaaa

SEQ ID NO: 15461 - DNA, 386 bp, Homo sapiens
gatttcacagtttcgactctgttttggtatttagaggtcttgcacagtgaagcctttttcctatatcctgttaacatatcaccctgaaagaaattgttagaaaaaggctgggtactgtgactcacacctgtaatcccatactttgggaggacaaagcaggaggatcccttgaggccaggaattcaagaccagtctgggcgtcatagcgagatccaccccatctcttaaaaaaaaagccagacctggtggtggcgcacacctgtaatcccagccactcaggaggctgatgcagaaggatcatttgagcccaggagttccagactgcagtgagctatgattgggccactgcactccagccattgtgacacagtgagatcatgtttctt

SEQ ID NO: 15462 - DNA, 275 bp, Homo sapiens
actgacaagaaacaaatctttaaaggacacagttgtttgaactaatgactccttcattagcagccatactaaaatctttgtaaaagttcaagaaattatacattttggaataaccactattatagtgttacatatatctataagcaactttgatcactggtattggctatgtaaaattatgttgatcgatactaagatgtttattgaagacagttaatttaaaatggcattaaaatggagcttctttgaaaaaaaatctaatgatgtatgaatgc

SEQ ID NO: 15463 - DNA, 679 bp, Homo sapiens
actgacaagaaacaaatctttaaaggacacagttgtttgaactaatgactccttcattagcagccatactaaaatctttgtaaaagttcaagaaattatacattttggaataaccactattatagtgttacatatatctataagcaactttgatcactggtattggctatgtaaaattatgttgatcgatactaagatgtttattgaagacagttaatttaattgcattcatacatcattagattttttttcaaagaagctccattttaatgccattttatattattttagaactttctattgtttgtttaccacagatttatatttgagagtaagagttgatattaatacaaatggcatgtgccttttctgatattactcttagaaataagaagaaaatgctgggtgtggtggctcacacctgtaatcccagcactttgggaggctgaggtgggcagatcatgaggtcaggagttcgagaccagcctgaccaacatggtgaaaccctgtctctactaaaaatacaaaaattagctgggcgtggtggcgcatgcctgtaatcccagctactcaggaggctgaggcaagagaattgcttgaacctgggatgtggaggttgcggtgagctgagatcacaccattgcactccagcctgagcaacagagcaagatgccaaaaa

SEQ ID NO: 15464 - DNA, 374 bp, Homo sapiens
ctaaaactcaatgacatttccatttttaatattctgactttatgttaaatgtcttcttgtttaaagatgtatggacaatgggccgggcatggtggctcacgccttaatcccaggactttgggagtctgaggcaggcggatcacgaggtcaggagattgagatcatcctggctaacacggtgaaaccccatctctactaaaaaaatacaaaataattagccaggcgtggtggcgggcgcctgtagtcccagctactcaggaggctgaggcaggagaatggcgtgaacccgggaggcggagcttgcagtgagccgagatcgcaccactgcactccagcctgggcaacagagcaagactctgtctcaaaaaaaaaaa

SEQ ID NO: 15465 - DNA, 582 bp, Homo sapiens
tagagtcttatgtttattcatttcacatttattgactgtaaactgtcttatggtctgtttttctttgagctaacttactttccacaagtgccatatcaaatgaagtaattaatgcaacaagaactttgtaaactctaaagcactatacaaatgtcattttccttccagtcccactgcgatgacatgaattaatgttacttcctcttccaatctatacaggagcctctaactgaactatctccttcccaaattctccttagattatatattttgcaccctgctgcccacttagtcttcttaaagccttgctataattatgcacctctcctactcaaaaactttgactgccttccagttcttgaccaaatagtatacaaagtccttgacttgtaaccaagaccttccctgatgtggcttcagattgccctttcactgtttctcactcttctcccacccaaaccctggattttcaagtaagtttagcccactaacctttccctgagcccaactgccttcccccacttgtctttcactcatgcttcccctctgaatggaaagcttcctgcataccttctccttaaa

SEQ ID NO: 15466 - DNA, 672 bp, Homo sapiens
tagagtcttatgtttattcatttcacatttattgactgtaaactgtcttatggtctgtttttctttgagctaacttactttccacaagtgccatatcaaatgaagtaattaatgcaacaagaactttgtaaactctaaagcactatacaaatgtcattttccttccagtcccactgcgatgacatgaattaatgttacttcctcttccaatctatacaggagcctctaactgaactatctccttcccaaattctccttagattatatattttgcaccctgctgcccacttagtcttcttaaagccttgctataattatgcacctctcctactcaaaaactttgactgccttccagttcttgaccaaatagtatacaaagtccttgacttgtaaccaagaccttccctgatgtggcttcagattgccctttcactgtttctcactcttctcccacccaaaccctggattttcaagtagaatggtggtcaccaggggctgggggagggggagaggagagttactattcaatgagtacagagtttcagcttaggaagaggaaaagagttacacagagctagatagtggtacaacaatgtaaatctacttaatgccactaaactgtatacctaaagctggttaagatgttaagttttatattatgtgtattttatc

SEQ ID NO: 15467 - DNA, 478 bp, Homo sapiens
ccatgtacacagctggaactgtattttgccgaacctgagccatctacaactgtgattctttgattcataactttctctacacactagctcaataagaattgctggtttgccattttcctaggaacctagttttgaaaaatcttggaaagaagataattcttcccgtttatgatatatgaactactcccctctgtatttctcctgattcctagtaatttacctattgtagcttcactgaataggaactcactatcttaatagagatcttttatttatttatttatttatttatttatttagagacagggtcttactctctcactcaggctagagtgcagtgacgtgatcacagctcactgcagcctcagcctcccaggctgaggcaggagaattgctggaacttgggaggcggaggtttcagtgagccgagatgtgccattgcactccagcggggggcagcagagcaagactccatctc

SEQ ID NO: 15468 - DNA, 307 bp, Homo sapiens
tgagacagggtctggctctgttgcccaggctggagtgcattggtgcaatctcggctcactgcacccttgctgtcctgggctcaagcagtcctcccacctcagcctcccaagtagctgggactacaggagtgtgccaccaccatgcctggtattttttggtatttttttatagaggcaaaattttaccatgttgcccaggctggtctcagactcttgtgctgaaaagcaatctgtccgccttggcctcccaaagtgttgggattgcaggtgtgagccaccacgcccataaaactgtttaaaactgttt

SEQ ID NO: 15469 - DNA, 484 bp, Homo sapiens
cttacatcatcattgtcatcatcaccatcatcatcatcatcatcatcgtcatcatcatcatcaccgtcgttactgttatataaatcatcttgatcaacttaacagaataaacatgacacctatttagaattctcttctgattgcttctaatattcctttgcagttttaacacagcttataagttcacctgacatattttttggtgctgattttgtcacttaacatgacttcaccaaatggtttcatcagatagtttccctctgtccatcctttcatatttcattctgttactcttccttaccgtaccataatctgaatgggctctatatacaggtgctgtggagcatcttttgtaaaaacttccttgtggtgacattttagattatttttatgggatatagtccaccaaccgtaattacctggtcagcgttttaaactcttgcaacactaaatatatacacctacaatatacccgcaaaaatta

SEQ ID NO: 15470 - DNA, 358 bp, Homo sapiens
attgtgaaatgcgtcgaccacactgaaggtatttgttaatgagggttccagaagcgttaaaagtagcaccaccaaaagccgggtgtggtggctcacgcctgtaatcccggcattttgggaggccgaggtgggcagatcacgaggtcaggagatcgagaccatcctggctaacacggtgaagccccgtctctactagaaatacaaaaaattggccgggtgcggtggtgggcaccagtggtcccagctactgggaggctgaggcgggagaatggcgtgaacccaggaggcgaagcttgcagtgagctgatatcatgccactgcactccagcctgggcaacagtgtgagactccatctcaa

SEQ ID NO: 15471 - DNA, 377 bp, Homo sapiens
taggttttgggacctatctttattttgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagataaa

SEQ ID NO: 15472 - DNA, 452 bp, Homo sapiens
accaagagtcattgtcaatggcctataatgcctttcaccccaccaggctgtgttcttcccacctcctgactttatacatggctactcccaggacaagcttcttccagatggtccagctcgtttcctgcctgactttcccaatgagcccttgtgttggctcctttggccctctttttgaaagagtggacaagaatcagatgattctgaggtcttgcatttgttttcattttgtgtgtgaaatggtgtttaaggtccatagcattaagtttgaaggaaagatagtttcaggagagagctgagactctatacttttcccaaggtttatttgcattgccaatgaaacatccattaaagccatctcagccaactatagagtttgaattggggaagaaaataccacggtggaaaagtagaatttgatgttagccatgcagatggcgactgaacttaag

SEQ ID NO: 15473 - DNA, 480 bp, Homo sapiens
tttagggcttactatttaactacatgagaagcaggcacagctggaagtaaaacgcatatccctcagaatcaaggatcccatttgcacattgaatcctgggtcccccaaaagagacaaacacaacaggaggagacagtgcaatgtttccacagtatacttcactgtgaggacattccctggaggctgctaggcaacccaacaccagtcagcacactctataatcagcccattccctagacattaaacacaccaaggtcaagttttttcacaatacaaagtaatttctcatgtccttcaaagccaaagagatcaggtaaggcaatgcaaaagagactgaatatgacaaagaggaaagaagaataaggtggattaaaaataaataagagaacaatttttaagaaaggaagcaaacgtaagtaccatgtacataatttagaaaaaagttttagccaactaaaaatattccgcaaaacaggatcc

SEQ ID NO: 15474 - DNA, 168 bp, Homo sapiens
ttgcaaaaattaacaaatgtgctgcttggttaaaatggctaggctcttctggctcactctttgatgtgttctattttagttggtttgcatcttgcctaaggtgcatattccaaactcttggtattatcttcctgatagtcatattagtagtctcctggtgtgttgtat

SEQ ID NO: 15475 - DNA, 406 bp, Homo sapiens
aaattcggtatcagattggaaagtacaattgaagacaccactcagaaaatacaacaaaaagcaaaggaactggacatgggggcacacacctgtagttccagcaactcaggaggctgaggcaggaagattgcttgagcccaagagttcaaggctgcggtgagctatcatcacgccactgcactccagcctgggtgacagagtgcagataagaccccatctctaaaaaaagagaaaaagaatacagtaagtaacatttaaaatttaaaaatcacaaattggcggggtgcggtggctcacgcctgtaatcccagcactctgggaggctgaggcaggtggatcacctgaggtcaggtgttcgagaccagtctggccaacatggtgaaaccccatctctaataaaaataca

SEQ ID NO: 15476 - DNA, 3399 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgtaagtacttgctgtcttcattttcatgttgcatggttcataacattgcatgccattattagccatgaagggaatatctttgtcacataggaattgttcagcaacagaaagatactttgtaatgagaaggtacaaatttgagtaaatgcaagtttggtttgaatgccataataaaatgatataaacagtgcttctgacaatatctgtatatttttgagcaggctgtaactatcttaatagaatagtacaataaaacacaaccccccacccagcattaaaaaatagttttactggaataaaatgggtttggcatcatgttgttttatgcttataaagcattttcatatgaacagaaagtttatatttttctgtttttgaccttaggtatatgaagttttctaaaatattttattaatttatgttgaaattgtgggtatgcttcagttaggatatgtcttttttaagtgctgtaaagagtagttgtaattggaatttctactgtataaatgttttacattaagtgttacgagccacaaatttcatgtacatttattatatatctatacatgcatatgcacaagcacataactgtggtcatctctgtagtttactaactgccttaaaattgcatggttcttaatggcattcgcctcaagtagtgtgtttgtataaattctgttttgtaacaaaatagtttttcaggcagtgcgtttctcaggactttatagcttattctacttattcttatgttagtctctaaattatttttcttcttatgaaaactacagtgtaacacagagtaataatcaaacattgctataaaccaagaatgacatttttcaaaaaggtgttgatttgtacagatttttaaagtcagttaactttactgctattttattacctaatactttttttagatgcaacaaacccttgaatttctatttgtattcgaagacaagtcattcctattattatagaataaccaaaaccttatttatgttttacctttgctttaaaactctcatgtatgttatctacagagaggatcattacagagacagactctcccgagacatgggccacactgatagaatagagaatttgagaaaaatctgggtctttctaaaaactgctttgtaagttactttttctttatgacttctgtgggattttgttgatattttcttagagaatgaccaaatctcctttcttgccataattaacatttagtaattatgtagaaacgcactgcttggtcaggcttcctgcctagctatatattacgttgtcttccttactacataaatgtacttctttaatcttgtgattacagtaactgcaagtgtgtttttacatctgcatttttaaaacattttactgtaattctgttgtgtgtgtgtgtgttatatgataaatgtacatacatgga

SEQ ID NO: 15477 - DNA, 453 bp, Homo sapiens
aagtaagaactcaactcctgtccttctgtgtgttttccgccagccatgcccggttacgctgtatgtgcacctgcaacaggtgtacattttgcatctgtcagaacttcctcaactcagacttgctgcaatctgtaaagaacaaaatcttcactgcagttcttaacaggttcttaactttatttactgggtacccaggcattctgttaaaatacaaaagaaaaaagcggataactatttattatacagatactcactacaaagacaagctgactgatgcccaactaacttccactaaaattctcactgtgatgacaatgtttagttttggaagcatccttaataatgtttttatattaataggtatatttagaggactataaaataagattttggatgtttttttcataaggaagataaattatctttcctattaaaagataatatgtataggga

SEQ ID NO: 15478 - DNA, 539 bp, Homo sapiens
  misc_feature (8)..(8): n is a, c, g, or t
  misc_feature (24)..(24): n is a, c, g, or t
  misc_feature (31)..(31): n is a, c, g, or t
cgttaccnggctttcccttgtgtntgctacnccatgtcattttgagggatgttagatgagtgttgcatagagtttagcttggccattagtttttatgggagtgtctgcgatatggaacattgagcttcctgtcatttgtagaagcagaacagagtgatgaacaacttcatcaagaaatatctcaggttcctccccgggcagaagaaatcaccattccagctgatgtcaccccagagagagttccaacacacattgtagattactcaggtaatgaatatcctcttgtagatgaaggtgtaggttaatttaatagacttgaaaaaagatacttactgagcttttacaaatgttcagagaggtggtcttttctctgtagcagtaaatgatcctttacgattcttatctcatttatgtctgtcaacctctaccctataccccacccagtgcctccatctgacagttcttcgtccccagattactaagttgggttccataatacctgtggctgttgacacttgaaatgtgactgttctaaatga

SEQ ID NO: 15479 - DNA, 280 bp, Homo sapiens
gatgggtattaatctcgatcagaccaaattatggtataatgaagattgccagcaggtggctctagaatatactttcagtaatacggatagtttccttcctttttagctactgcttgtactttatgcagaacaaatacatcttttattttaggtcttaagaactaagaaacataaaatcaatatctcctttgtactgataaatagtacacagtgtagggaagaatgcccttttatttataacacacctgcacatatacacagagatgtttgtatattgttg

SEQ ID NO: 15480 - DNA, 3082 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15481 - DNA, 3206 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagagattgttgtggatttaaatacctcctcatttgcagagtatcttcagccttcaacaaaatagaatgaaaacaacatatttaaaaaatctaacaccgaaacaccaaattaatccaagaatccactgagttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15482 - DNA, 3301 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15483 - DNA, 3205 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15484 - DNA, 3178 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15485 - DNA, 3351 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtgatcttgagttcttttgtcatctaaagtaaatatttctgtacagatgtgagt

SEQ ID NO: 15486 - DNA, 3134 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaaggaaaaaactggaaataatcaagatggctaacaatggacgatgatttactgaacaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15487 - DNA, 1493 bp, Homo sapiens
cggacgcgtgggattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattactccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15488 - DNA, 3302 bp, Homo sapiens
  misc_feature (3091)..(3091): n is a, c, g, or t
  misc_feature (3095)..(3095): n is a, c, g, or t
  misc_feature (3099)..(3099): n is a, c, g, or t
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcaaaaaaaaanaaanaaanaaaaaaaaaaattggggggggggtgggccggaaaaaaggttcacaaccactcgtggggcggggccagaggaaggaccatggccaaacgcgccaagagaaccgggcaggcaagggggggtctccccaataaaaccgcggggcacggggtctgacatccagggcggggctacggccacacggcagggcgagcgccggggggggcg

SEQ ID NO: 15489 - DNA, 2302 bp, Homo sapiens
agatattgagattttcggttctgttttcagaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaaggtttgttgctcctacagactatgactgaatgtaacttcatatggactttttatggaattgcagtgtggtgtttcctaaccacaaaaatgcaacaaaatcatgtgtattttaaaaatacatacatctttaccctattcctgaaggttctggttttgttctaaagtggtagagtctcagacatacatatttctgaaagttttcgacatgtgattgtgaggtgcattcctgattgagaacttttacattaatgcaagctcttcccagctgttaaaagttacatatgtctgccttctctctgatgaaaaaaaagagtagtacatatggattatatattgccaaatataccaagaataacagccagaggaaagggataaatctgaagcttagaaagtctatcagtcacttagggattatcaataagattcaataggagtaaaaagctatatgtacaaaggtgtttattctagcattgtttttaacaggaaaaaactggaaataatcaagatggctaacaatggacgatgatttactgaacaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15490 - DNA, 1169 bp, Homo sapiens
gtatagggttttcatactaatcatgttttaaataataattatattttctgactgcaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15491 - DNA, 3051 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataagaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 15492 - DNA, 2380 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgctgcaatctgtaaagaacaaaatcttcactgcagttcttaacaggttcttaactttatttactgggtacccaggcattctgttaaaatacaaaagaaaaaagcggataactatttattatacagatactcactacaaagacaagctgactgatgcccaactaacttccactaaaattctcactgtgatgacaatgtttagttttggaagcatccttaataatgtttttatattaataggtatatttagaggactataaaataagattttggatgtttttttcataaggaagataaattatctttcctattaaaagataatatgtataggga

SEQ ID NO: 15493 - DNA, 3708 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgtaagtacttgctgtcttcattttcatgttgcatggttcataacattgcatgccattattagccatgaagggaatatctttgtcacataggaattgttcagcaacagaaagatactttgtaatgagaaggtacaaatttgagtaaatgcaagtttggtttgaatgccataataaaatgatataaacagtgcttctgacaatatctgtatatttttgagcaggctgtaactatcttaatagaatagtacaataaaacacaaccccccacccagcattaaaaaatagttttactggaataaaatgggtttggcatcatgttgttttatgcttataaagcattttcatatgaacagaaagtttatatttttctgtttttgaccttaggtatatgaagttttctaaaatattttattaatttatgttgaaattgtgggtatgcttcagttaggatatgtcttttttaagtgctgtaaagagtagttgtaattggaatttctactgtataaatgttttacattaagtgttacgagccacaaatttcatgtacatttattatatatctatacatgcatatgcacaagcacataactgtggtcatctctgtagtttactaactgccttaaaattgcatggttcttaatggcattcgcctcaagtagtgtgtttgtataaattctgttttgtaacaaaatagtttttcaggcagtgcgtttctcaggactttatagcttattctacttattcttatgttagtctctaaattatttttcttcttatgaaaactacagtgtaacacagagtaataatcaaacattgctataaaccaagaatgacatttttcaaaaaggtgttgatttgtacagatttttaaagtcagttaactttactgctattttattacctaatactttttttagatgcaacaaacccttgaatttctatttgtattcgaagacaagtcattcctattattatagaataaccaaaaccttatttatgttttacctttgctttaaaactctcatgtatgttatctacagagaggatcattacagagacagactctcccgagacatgggccacactgatagaatagagaatttgagaaaaatctgggtctttctaaaaactgctttccctagagaaacaggagctcagctgacaatgacctgaggggacccctacagtgcttcaaacagtggatggaggaggagatgccttcctggttaagaaattatccctgagcccttgtagaggacagtccagcacaggaaattctggaactacaagatgaaaatgtgtgccagcatgcttctactttcagggtacagtctgaggccctagggaggaggagttcctcaagtgctttgacctcttgccaggacaaagacggagaagtattttagaagcatctgaatttgttagctcttcagttttcctcctccactccctaccctgcacacagagcctcagaaggacagaccagcttcacccccttaccagcaattactgaagaatcacaccccacccacctcaggatcactgatctccttcctatatgggaaccctgacccttggagaaaaaccgctgacctacaaactccccacattcacctagagagcaccagagcagagttctgagtgagataagcagtcctttagggggatctgtttttccagctctcatttttccccccttatttcctttatctctagaattctaagagctgtactgtta

SEQ ID NO: 15494 - DNA, 1117 bp, Homo sapiens
agcgggccgccgccgcgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacgtgagtccgcaccctctggccggcccctgagtccctgccctccctgcccctgcagcccctgtcgcccctgtcgcccctgcagccccaacctttgcagccccggcccttctcgcgcctcacagctccgctcgcctttctccgcgttcctaggccttccagccccttcactcttctcttttggctggccgccggcggccctcaccctgtcacctcacctgggccctccagagatctcctttccctgttccccagccgtcctcccaagccatgtccctattagccctaaccgcccgacctcatccctccgaagcttctctcctccttttcctcttcgaaccctgtccttctgggcctcacagtttcccaggccgcctcctttcagaccttcttgtcttctggagattcccttatcactgccaggcaggtgctggaataagcagaccgaccaatagggattgcgtgaaccggctcccggggaagctgggggaggggtgcagaactattcgacttgtgggcaaggtcaggtttctgcatttttttggcactcgcagtcttcactctctctatgtattgacattaagatatgagtagtggagagggccggatcctttttagcagtacttgtactttgcattggactaactcctcgtactcgagatatttcatcaaaaatttttactcaacttcgagttatgcaagcgctcaatgaattagaattatctggggagggtccaattgttgttaccctaaagcgtaatctttgccctctttttaagcattatttattccatagttactacgtagttaacttattaataaccataggcactgtttgtacgggtaccgagc

SEQ ID NO: 15495 - DNA, 526 bp, Homo sapiens
ccacaccctgccgacatatttctagatgggtattaatctcgatcagaccaaattatggtataatgaagattgccagcaggtggctctagaatatactttcagtaatacggatagtttccttcctttttagctactgcttgtactttatgcagaacaaatacatcttttattttaggtcttaagaactaagaaacataaaatcaatatctcctttgtactgataaatagtacacagtgtagggaagaatgcccttttatttataacacacctgcacatatacacagagatgtttgtatattgttgaaaactagttactgcagatattgagattttcggttctgttttcagaggcagaagaaaattcgtgaagatcataaatcctactatgcgattaacactgtttatgtatatggacaagagaaatacttgttggtaagaaattctgtggcatacaaaaattactaattattgggtacatttttaaatgactctttgaaaacaaattggcttcaattgaatgactct

SEQ ID NO: 15496 - DNA, 678 bp, Homo sapiens
cccttcccccaagcccaggaaagtgaaaagagaagcaggaacagtaaaatactccacaggaaagaaaaatcttagtgatccctcctgctgtctctttccttttgcctattctggcaaattttgtaagtgaaatttgttaccaagatgtgaaaatcttataagaaagtctctaaatatttgagaataaaattatcaatgtctcagctctgcaggctgaaaaaacggaggctttacaaaataaaatcatgcttggaaaacttctcctctgagggatgtcaaaggctgcactgaataagctctaaggtggtgctgaaatgagtcatttatttgcctgtgtaagctcaggcaggtgttggaattgaggaagtataggtaatgaaaaaagtaaacatgtcctcgggacatagcgactggtgatgaccacacaatcaacacaataaactctagcattcacattgtagtccagctcattcaagcaaagctatctccaatagggagtttaccctgtacagaacacgtgcatttccacctgttctcagactgaccctttgctcatcacaatagtgaaaaaaaacacagccctgggtggagatttaagatgctaatgagtcatgagatgtatgaacaagcatgtacagctactgcacacgtgcacccagaagaccgcccagaacatgc

SEQ ID NO: 15497 - DNA, 287 bp, Homo sapiens
gtaggaagtgttcctagtaaatctatgctgactcaaaggactcagtgtagagttgtgttcacagctataatttgtcatagtggaagactagaaggcaaaatcagcaaaggaaaagtatggaatgaagtgtaggggaaaccagatgtaagctttcaagggtcctctcccggaggagtcacacggagtgcttaaatccagcagcaacaagttaagataacacatgtgaaatgttttccacccaggtagcttattagagaactagagtttttattgggggctggttaagt

SEQ ID NO: 15498 - DNA, 470 bp, Homo sapiens
caagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttcctttacagc

SEQ ID NO: 15499 - DNA, 496 bp, Homo sapiens
gttttttaacttttgttttaggtttgggggtacatatgcaggtttgttatataggtaaactcatgtcacaggggtttgttgtacagataatttcctcacccaggtactaagcctagtacccaatagttgctttttctcctcctctctctcctcccaccctccaccctcaaataggccccagtgtatgttgttctcttcattatgttcatgaagttgagagagtgttttgaaaaagaatgttggaaagcatttccactgttagatgattttaagtcaaaaagttatacaacagtgtgacctatttgcacacaagcatggacacagaattgtgtcatatgtttaaaacttttctagatccttttgtggttcataagcttgatgattgagttttcgcgtccacatgtgagatgtgcctcccttgagccttgtcattggcacattacctgcctgatgtgaacaataaaaataaaaaataaaaatttgctaagcagaaaaa

SEQ ID NO: 15500 - DNA, 447 bp, Homo sapiens
cacctgtcgcacagggtttgttgtactcaaaggaaaaaaaatgtcttttttctagaacgaaacagggaactgaaaaagactttgtcctttgacaaaaaccgagtcctttctgatgagacccacctttgggcttccctctcagtcactgtagaatccagtctgagcaacaatcgtgctagttcagtttagtgaaaatccccagcccttggtatctgaccaccctggatatcctgtcactttggcctgccttcagcaataatcctatcaagtcagtttggccagaagtccttatccttgatgtttcctcatagtaattttccatctgctggcgctcaccttactccatggttctaaatctccatgtacgcttgttggggtaagggttgagcccttatacctatcaccatggctccctacccctttgaataaagtccactttaccatgtt

SEQ ID NO: 15501 - DNA, 316 bp, Homo sapiens
gatatatttcagtatctctaagagcccagcacagtgcttagactacattaggaacttaaatgtttataataatgaaataaaatactaccgaataattttggttttcatgagcacatagaagcagatgataaaattaaaaagctctgacatgtgataggaagccagagaaagtacatttggaaatatagttacgttgacaaatcaagagttgactgtatttctaccagagatcaaacctcccatagaacatgtatgtctacaaccaaatctggaaccagccactgtgacataaactcttgaacactctacttcaaag

SEQ ID NO: 15502 - DNA, 944 bp, Homo sapiens
gagaattgcttgaactcaggaggtgaaggttgcagtaagctgagattgtgccactgcaccccagcctgggtgacagagcaagactccatcacaaaaaaaaaaaaaaaaaaaaaaaattcaggccgttactggagagtcttggggaaatttttttttaaaatgtctgaaaatttttccacttaatccattgatgaatttcaaagcaattgtattttttcatacaagcctgccactgtgagcctgttcttattgtatctgagctctttgtgctgcctgaattttgtctcttaatttcttttcagcttcatagtgtttcattcttcaattgtgttggagggaaaaataatggtagaaactaaaacacactttgaccttttttttccaatttgtagatggcatttggtaggcttttggagtaatagcctatttcaaaaaataaaaggtgatgcaaattattgtggaagtgagaggcaagaaatttgtatttggaggttgacattagagtaagtttaacccttcacactcaaaaactcccatcctctgaaggcaggagttctcaaccttggctgtctgttaggattgcttggggagctttctgcaattctgatgcctgggttgcttctcagaccaaaaatcagaatctcaggtagtggaaccaaggcatcagctttaaaaaaaactcctttggtagttccagtgggcagctaagaacactacagtgacttttaggtatttgcagacaatatttaatttttttcttaatatctctgtggttggaaaggatctttgtagcaggaatttttttattagaaatagaccaaggcacagagaggttgaatttctgccttgtgtgcccggttccagcacagtgcggttgtgtcgttggtcttttttagtatttcctatttccaattttctaagaaaagacagaattaaaaaaaaaa

SEQ ID NO: 15503 - DNA, 491 bp, Homo sapiens
agactgaagatcaggtgggtacattgtgtttgaagcaacatctgtatctcccaagccacggcaaaggagcatctgaaactcatccagatttagtagatgagactaagctggtgaacactcagttccatttaaccccttattggcagcctatgctcacactctttcctggttggcaagtgaagaaggtgggtataggggattttggcaaggatgttagtggatagagtattttttgactgggcatggtggctcatgcctgtaatcccagcactttgggaggctgaggcgggtggatcacctgaagtcaggagttcaagaccagcctggccaacatggtgaaaccctgtctctactaaaaatacaaaaaattatctgggagtggtggcagacgcctgtaatcccagctactcgggaggctgaggcaggagaatcgcttgaacccaggaagcagaggttgcggtgagccaagattgcatcactgcactccagcc

SEQ ID NO: 15504 - DNA, 349 bp, Homo sapiens
atgagggacatttggactgagatttggcctaggaatttgggccacccgggtggaaagtcccggaagagaatgccgggcaagtagatcagcaaagggtctgactctcccttggtaggggtctagagaggtattttgagggatgtccattgaacatattctttttggagcctgcctccgtcctgctgaattcctgccttgtgatttgtcgtgtcagaacacttagaaataatgctctacccagctcatgcctctaatcccaacactttgggaggccgaggctggaggattgcttgaggccaggagtttgagaccagccaggacaacatagcaagactcgatctctagttaa

SEQ ID NO: 15505 - DNA, 394 bp, Homo sapiens
caggctagtagtcttggcatcacttggggatttggtaagcatgcagattgccaggctccctccacacctactgaaccagaaattctggaggtgggcttagaaatctgtattgtaacaagccttccagataattctggtgctcactcaagtttgagaaccattggaatagtggtttcattataaagaacatgaagcctgtaggataacttagtggctattgctgactagcttcagtgatcaaattttcaactttatgtctcctgtgaaaaatgtcttgttctgggaaaaatattctgtgaaattttttaagcccagttgagttgtgcctttttggctatgtgcccctcattttggcaaagggccagtgctgagtgcaatgcagttacccaactca

SEQ ID NO: 15506 - DNA, 526 bp, Homo sapiens
cgatatgaattgccattgcctcccacaaagaaaaatggacaaaatatgggaccacatctttgagatgaaatgtgcccaaaatgaaaagtaacttgagtatcccaagttaaacttaatcattagctgcaaatggacgattttcaaatttcaaatagtgatttttgaagatttgcccaaactagagtactatccctcttcacactaagaggcagaaagtggtttcacacacccttttatttaatcagctaaagtgggtgcggtgacacacacctgtaaactcaaccactaaggagactgaggcgggaggattacttgagcccaggagttcgagatcagcctgagcaacataacaagaccctgtctcaaataatacttagctattacccatattgcttttagcctgctgccaggaggggagaaatgttattgtttgaacagatgtcagatgtgagtaatgctcagctgtgttcaatgtagaaaattaataaaagttccaggagtcatcctggctagatcaaaaagcaca

SEQ ID NO: 15507 - DNA, 5784 bp, Homo sapiens
  misc_feature (1594)..(1594): n is a, c, g, or t
ggccaggacagtgactgctggccgcgaatttcacaacacaggtggcttcctcacaggaagctcctctgtataccacaccctgttgctactgagtggagcagccaaattaaattaagcttgcattgctcaaaattaattttcctaagagaaatacaaatacaccaatagattagggtattttatacatttttaatttcatttttgctcttcttttatagccagtgtgcacatgtaagagttatggaatcacttagagcaatactgagcattttcatttatataaaacccaaatcatttgggtgcagaagtttggatgattgaagctcagagggaaggagaaaagcatttgagatgaaaaccaaagagtaaatttgagtttggcaaaagaacagattgcacttttggtttgtaccacctctttacaaatttgttaaaggaatactaggtgccaagcctgtgtgggcaccatagataatgcagataaatagaatacaatcccagcaagctcatcttctagctagaaacctcagaaagacacaaataagagcagtaaaaagggattggccggaaagaatgacagaaaagagtaatggagaaatcctagaggtgctgaagggagaaggagaatagatcaaagatcaggcagtgttctttcttttaaatgattagcctttcatttcatcccaacaactggacagcaagataagtaactggacttcaaactagtgagtgtatttttaaggccctgcttgttaaagaaaggcttgaactggcctctcctcatcactgcttcttccaacaggccctcatcaccttttttcaagtcaagatttcatcccatacatgcatgactcaatcagatttggaaatgtggatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 15508 - DNA, 2588 bp, Homo sapiens
  misc_feature (1447)..(1447): n is a, c, g, or t
  misc_feature (2568)..(2568): n is a, c, g, or t
ataaatgacgtgccgagagagcgagcgaacgcgcagccgggagagcggagtctcctgcctcccgccccccacccctccagctcctgctcctcctccgctccccatacacagacgcgctcacacccgctccctcactcgaacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagagtaagttttatgatttcctgctttcaaatgaatgatcagggtctctatttatggctactagtaataagagttgattgaatgattttgtgtctggcaccatgttagacagttttcatactttttctatatttctcgcttcatttagcaattcagtgcatccattgcagcaaataatttttgccttattgaatctctaaatgccttaacaagtgaccctgacagtgctgcacctgtcatacacattgttgcaggattcctggtggttgtgccaatgaaaatctgcacagacaaactacaatttgtagatttatctcgtgatctagacaaagtgactactgttttttttcatattgtgttcaaaccatctgggtgagcctcaagttattactaagcagtttatccaattgcatcagcattgattgacctgctgcttattcagagggattagaccattggtggagagaagcgagctctggctgtgacatcagttgtcaggagaactgggatggaacgccacctctgctacttcctgcctgtgtcacctggttcctgcttttggctctctcctgcctacagtggaaatgnctacaatatttaacctcaga

SEQ ID NO: 15509 - DNA, 2446 bp, Homo sapiens
  misc_feature (1709)..(1709): n is a, c, g, or t
  misc_feature (1763)..(1763): n is a, c, g, or t
  misc_feature (1853)..(1853): n is a, c, g, or t
  misc_feature (1920)..(1920): n is a, c, g, or t
ggagacagagtgccactctggcacccatgctggagtgcagtggcacgatcttggctcactgcaacctccaccttgcaggttcaagcgattctcgtgcctcagcctcccgagtagctgggattacaggcacatgccaccacacccagctaatttttatatttttagtggagatggggtttcaccatgttggccaggctggtctcgaactcctgacctcaggtgattcaccaccacccccccaccccccagcctcccaaagtggtggaattacaggcatgagccaccgcccaggccgaaattatcacttctaacacattcctgggtgttgctgatgctgccagtctggagaccacactttgagaaccactgggttaatttagcatctcatggggagacagctgtgctatagtgaaatgagtagacccttgagatctacttggacacaaactcctggggcagtagttctcaattgggctactccactttggagtcacctggggagcttttaaaattcttgacccctgggctccaccccagaccaattaaatgagaatctctaggcgcaggacccagacaagagttgtttcttcaagctccccaggtgattgcactgcacagtcaagggtgaaaaccactttgccaattcggcttaagcaaatttccttgtctattaagtgataacgataaaatttgctgtatttgtatcacagggccattgtgagaatcacatgagactgtgaatgtgaaggggttttataaactgtaacacctaaaagtaagaatttaggcattgatggtcttggaagggcctgtttgcaagtgatgccatcatccccactgaagcaggataatgctgctctctctggtttgcattctagtactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtaattactactattttatcttcagtctacgtcctttgaagaagcctgaaaccttctgtgtttgtaactgaatcattggtgaaacgttttctcaagaagcaaatgtgaaatatgatcaggcactaaaaagactgagcagcgagtcacggagggagcactaggcttgccaccaggacccgtgggttctagtcccagttctaatgtggacttgctgtcacaccctgagcaggtcacttgcctgacgggaagttcaattccatcctccttaaaaggaagaggttggatttgatgatctcttgaggtcccttgcagctccaacattctatgattctcgaaagattctcatagtgcataagctatttcctgggagcaagtgtttgctttggaacattgtatttacctcgtgggtttctgtttaacaagttactattctagcacacctgatggggccctaaagagttcccacaccttctcaacccccagttttattccaagagaacactcttagatagaaagatttagtccatcctatcatactcagtgacgccaaacacaaaaaggaaaagtgatttttcaaaaacatagaaccttggatctaagctcctctagtaagttccacatgtagattttntaaagtttattttattattgtttttattcacaaatagcctgtttaactccatcntccttgcttcctttcagttatatatttttaggagatgataccaactttttaccaaatattatcagaaaaatccatctttcccctctttcnctttcctgccatcacctccccaatttcatatcactaccagaaactcctgtttaatttttaaagtgcngattgccaggcctcattgccatctattttggtttggtagactgtggaagtccagaaatctgcatttttaacatatgctttaatgattctgatgtcatcagggtccatgttttatactctgagactaaatcattctgtcctgtgtatgccttctgtggagggatcagtaggagagatggggtggagttacaactagagtgccagtaatagcttaatttgtagccaatctagtgtacaccagagctgagccagcaatgtgactgtcatctattaggcatgcaacaaaggattaagtagactgtaagctccatgcaggcaggtgccatatatgtcctattcaccatgttttctcccagtgcctggctccaggaataacacatacttcatgctcagtagacacttggctgagtgaaggaatgaatgaagctgttcatccaagaagcacaaagagatatttgacttgtgaatacaacaggccaagatagatacatacgtggcaagagatttgaaagttaaaggaaatctaa

SEQ ID NO: 15510 - DNA, 1037 bp, Homo sapiens
ggccaggacagtgactgctggccgcgaatttcacaacacaggtggcttcctcacaggaagctcctctgtataccacaccctgttgctactgagtggagcagccaaattaaattaagcttgcattgctcaaaattaattttcctaagagaaatacaaatacaccaatagattagggtattttatacatttttaatttcatttttgctcttcttttatagccagtgtgcacatgtaagagttatggaatcacttagagcaatactgagcattttcatttatataaaacccaaatcatttgggtgcagaagtttggatgattgaagctcagagggaaggagaaaagcatttgagatgaaaaccaaagagtaaatttgagtttggcaaaagaacagattgcacttttggtttgtaccacctctttacaaatttgttaaaggaatactaggtgccaagcctgtgtgggcaccatagataatgcagataaatagaatacaatcccagcaagctcatcttctagctagaaacctcagaaagacacaaataagagcagtaaaaagggattggccggaaagaatgacagaaaagagtaatggagaaatcctagaggtgctgaagggagaaggagaatagatcaaagatcaggcagtgttctttcttttaaatgattagcctttcatttcatcccaacaactggacagcaagataagtaactggacttcaaactagtgagtgtatttttaaggccctgcttgttaaagaaaggcttgaactggcctctcctcatcactgcttcttccaacaggccctcatcaccttttttcaagtcaagatttcatcccatacatgcatgactcaatcagatttggaaatgtgggtaagagaaagatgtcaaaggaaatgtgaagtattcacttctctattagtcacaccttttacaccatagactccaaagaggcgttaagcacctggttttcctttggctcagaaaaaccaaccaccaaaaaccgccgtttttttaccatttatatttagccata

SEQ ID NO: 15511 - DNA, 5637 bp, Homo sapiens
  misc_feature (1447)..(1447): n is a, c, g, or t
ataaatgacgtgccgagagagcgagcgaacgcgcagccgggagagcggagtctcctgcctcccgccccccacccctccagctcctgctcctcctccgctccccatacacagacgcgctcacacccgctccctcactcgaacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 15512 - DNA, 5824 bp, Homo sapiens
  misc_feature (1447)..(1447): n is a, c, g, or t
ataaatgacgtgccgagagagcgagcgaacgcgcagccgggagagcggagtctcctgcctcccgccccccacccctccagctcctgctcctcctccgctccccatacacagacgcgctcacacccgctccctcactcgaacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggctactggtgtattgaataagcctgcttcatttaacagttttctcttaattattatgtaatagtatttgctgtgaactcttaagcacatccccaaaattgattttttaaaggcttagtaatgctgaaaaattaataggatttctgtattggatatatattaaaccttactgattggaaagaaggacatt

SEQ ID NO: 15513 - DNA, 5583 bp, Homo sapiens
  misc_feature (1447)..(1447): n is a, c, g, or t
ataaatgacgtgccgagagagcgagcgaacgcgcagccgggagagcggagtctcctgcctcccgccccccacccctccagctcctgctcctcctccgctccccatacacagacgcgctcacacccgctccctcactcgaacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggctcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 15514 - DNA, 5665 bp, Homo sapiens
  misc_feature (178)..(178): n is a, c, g, or t
  misc_feature (1475)..(1475): n is a, c, g, or t
gtgtgtatatatatatatatgggtgggtgttttgttgcagctgctgatctttttctttgcagatggtacaaactctcccgagtcaatttcctgggcctatgtccccacctagctgactgaagttatcaacaggggtccagtttgtgcaggctgctagccctattggaagagtggggangaggtgggagaaagcaaccacaacgtgtgtgggcaacctcaattggcactcataaaatgttagaatgtcaactctctcccttggccactaaatctctcacagggtagtttttcttgcctaactcaggtttacaaatcaatgtgtatgccttgggggaccaatggcctctttcctcccaaataaaccactggctttctctttgtccccctaggttatagctgaggagcccactccaattagtttataggattcaaagcctctttttaaaaacatctctgagcttatgaggaaagacttcaagtttcccaaatctagtggaggacagggcaagggaggaaagataggtacaggagtccacaggaggccaggttttggcacccctttgtcaggaattcagcttccttactagggatgaagaaaataagtgtggggctttgtgtctatgctaccagaaggaggagaggatgacacttcctctctgtttcccagattagagaacagtgaacccaatgctgcctgttggctagaaaacaagtgttaacttgcttctgagagacccttttctctgtccctgcagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 15515 - DNA, 5124 bp, Homo sapiens
  misc_feature (934)..(934): n is a, c, g, or t
agtcaatatagccaacagagcagcagctacgggcagcagaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagngccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgctcttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatcttctttttaaaaaatagtatgaatgtgaatactagaaaagatttaagaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 15516 - DNA, 266 bp, Homo sapiens
cgggacagctctctagaaactcgctctaaagacggaaccgccacagcactcaagtacgtatgagattcgcccagttaataaggggacttgctaaaaaagttggcttgctgggaagcgtcgctcctgaaattgacaactttgagtgtggggttccctcccctgaccttgccgcccggctccggctttgctagcccagcggcccgtaggttctgatctgaaacttttcccctgtagtgggcccgcggggatctctggagctcgtggga

SEQ ID NO: 15517 - DNA, 4029 bp, Homo sapiens
  misc_feature (32)..(32): n is a, c, g, or t
  misc_feature (106)..(106): n is a, c, g, or t
  misc_feature (108)..(108): n is a, c, g, or t
  misc_feature (1471)..(1471): n is a, c, g, or t
  misc_feature (1492)..(1492): n is a, c, g, or t
ttttatacattgtatgatttaagatctttcanggcagacatttatacttggtaacaattgccaatttttttttctggtttttgttgtagtatttcaaaatacttcntngacattgatagactcctacactacccctgggagctaggtaggtggaattatcatccaggccttctgtagggactgctgccacaacagagtggttgttcctaagacaaaggtcaaaaaaaggggtgttaataaacagtcctcaggtttaagggacttttttaggattacatcttaaattccaacaaatcagatttaggagttactgaaagtgaaattgatccatccctcatccaaactttgcaatactttcctgttctgacatcatttagatagttagctgtattatcagattagaaaccattgtaccaggctgctgaaaggaaaaggaggcaaaaagctaaacatgggatgaattctgaaccttttaacctggctgaagtacgttggtccctgttatgcaaataccttcaatcctctgctaagttcagtggaaataattttcttgaatgacaggtttattcagcaaggattcagttggtgattaatccccctttgatctagggtatttcacttaactaccagttacctcgttctgacaaagtgcaactgagattagggagatcactagaacactaccagggtgtgcgtttattctctataaccttttaaagcaagggccaagaatgcaatttattttcagtatttgaagatgtaaagtcctgtctgctaagttagaaagtcaattgaataccaaatgaagtttatttcttacgtaatagaacaaacatttctttttgcttcgcctaacaatgatattaggaaacataggctttgaagaaagaagaaacaaagactacattctaagtattgcttctagttttgtttcatgcactagggtatacttaactggcccttgacataaccaaaaatcaaagcagtggctacaacttagactgagaaaatgcttctgttttattaagctgcatggtttcttctcacctttccccctaccaccaccaccaccattagaaaatgtcatactgtgtggtaaagaaatccagttgaggaaaatgtgttgcagtacacagttatccaccttaagactaatgatttcgaagctttgttaactatttcttttcttgaggcaaaggagcttcttgtgtttccattataagaataattgcattcattttcagaatgcttttttaaaaaaaaaagtgacagcattaccaaaatagccgagtaattaaattttttctgcctgcctttttctcagttatctgagtacctcttcttccataattttaaattttgaaatattatatggaattttgcacagtattttgagaaagaaaaggtaatgtttcatggtaggtttctcaatttgctgtttaaaactgtttcaatagcaatgtcagtcttnatcttgtaagatgtcaaatcnggatttattcctccagtatattttaagacctttaaaaaaaaagtatagtgatttgttacaaaatatgtttttaaagattagattttgattaatgatttagttatatacagcattttaatgcttagtaattactgttctagtagcattttgcaatacaagggatgtatttagattattatactttttttggctcagactttttgtgatctaatttataaattgaaacaatgactcaaagaagtgcatacctaacttacgtttgtgccaagccagcctcctctagtttcaatttaataactagtttcaaaatatattttgatagcaagttcctaaaccacagcagaattgcggatcaggaaaaatacaagataacggcattctataaagatagagggcaggttcccatggctatgttgctaagaaactagtgtttttaatcattacactccgtgcagtcatatttaatcaataaaacaggatatattttgaaattcaccatcacagaatatatatatatatacacacaacatatatatacaagtatatgaatttacgtaaatgtgtacaacactagtgtgtctgacttggtgggtttccctgtgaaacatgtcagtatcatgtaagatgaagaatattttaagggcaaatattcaaatatctttcctccaaacacagtattagttaatagtaatgaaatgattcattaaactgaaaattgcaaaggaactcatgagttcctttgtgattgaaacaaagtgattaaaactcttatgacctgaaggctttccaactagcctccaactgtccgcaccagctgtttcatggatataacattagtgtttgtgtatagcctggaacaatacaaggctgtatctgtatcactagcttcttgccttataagcaggatactgcaaggtctggttgatttctctaatgccctagctaatctgcctaattgacatcagtgtcatgttaatgtatgatgcacaagcatttacagatggacaaatgctctacactaaaaaccacctgctgaattttttttccagtaggatgtgaaattttgcacttctaatctgttgaacatttaaagtcaaaactacatgtttcctttaaatggcctctttaaatgatattttatgtttataaattttgttatgaaaaatttaaaaattagttattcctcttaaatttttactttttccttcaaaggacttgggtgccctctgcaggttataaagagataattagtgactatatctattttaaaaccctgtgatttttctctttcatacacatagcctgcttacacccaatttcaaagaaagtgtgagctaatttatttatattaactcttattaatttgccagtggttgaagttggagtttcttttctccactggttttataggtgtgtttagtgtgaagaatgtgataccattgaacttccagactacttagctggggctctttaaatgttggaactatagtaacacacattccctcacagaaaggagattgggaaaatagctattttgaaagttattgcagatgtagggaatagcttgtttcccattatgtttctagaatattacacatttggagtaagccttgctttttcaacatgcatcatgtaaaattacatgaaagaaaataatttgaaaattacacaagatttctctttcttgatcttgttgatgatgattgtgttctagctcaaaaaacagaccttcttagaatttcttattttttaaaaaagtgagtactcaacagataatactttggtactgcccgttgcagacatgggcctactaaactagaaagagcatttgaagagcaaaaggcaaaggttccatcaccatcctgtggaaatacgtgagttgttcatttcagtacacccatagtttctcaacaggtgtagcagatttgtttctaaaggacataggagtgcattttttatatgaaaccagaactggagtggtaatggcacttctgattcaattaacttacttggtgaagctgccagggaaactaaatatgatgagaagaagaggaatgactggatcaaattaatagaaatagatctttttgcaagcaacataatgattctgatcatcaaccttgaaaagtaaattagaacaagcaaattgctgttgaaaaattctttcagcactctgctgttgctactcagctagtcatagctcagccagagggaaggaaaaaatgcactcggttttgcattaacaaaggaaacattattaaagtgaatgtttacattgtgtttattgaagtgttgaaagaatatttgttgcatcttcaagcaacctgctgctctccagactgttacagtgcatgagtgataataaaaatgagtcagtcacttgtacattttagaaaataaataacttttaacatagtatttctcaactatgttacttcaaaatgtttaagtgccaaacttaatgttaccttctctgctaaagatttttgtctctaggaaatatattccattaaaaaaaaaaagaaagaaactcattt

SEQ ID NO: 15518 - DNA, 528 bp, Homo sapiens
ttcttctcctcatccccctcctccttcttccttcctcctccctcctttttccttcttcttcttcttttttttttttaaataaccataacaaagcccaaaatgtcagcctccaaatgtcctctgttcccatctctggtctggggaagatcacagtccttatttgaagaggctggagcagtggtccttccagtgtctgttcaggatgtgtagggggtctgatatagtttggagatatgtcccctccaaattgcatgttgaaatttggtccccagtgttggaggtagggcctaatgggaggtgtttgggtccttggggtggatccatcatgaatggcttgatactgtccttgtggttatgagtgagttcttgctctattagtccctggagaactgatagttaaaaagaggctggtatctccctcctcctcttgctcctttgtcttgccatgtgtcaggccctccttcgccttctgctaggagtgaaagcagcccaagaccctcaccagatacagatgctgctgccatgctt

SEQ ID NO: 15519 - DNA, 252 bp, Homo sapiens
  misc_feature (207)..(207): n is a, c, g, or t
tccttcacctcagccactcaagtagctgggaccactggcacaccaccatgcctggctaatttttgtattattggtagagatgggggttcaccatgttacctgggctggtcttgaactctgggctcaagcaatctgcctgcctcggcctctcaaggtgttgggataacaggcgtcaagccaccgtgcccaaatttgtcttttagagcngtgctggagcatcctctcctaggctgggaggttgctaatgtaaat

SEQ ID NO: 15520 - DNA, 399 bp, Homo sapiens
acaaaaatgataaataatgctttataaaggtaaaacacaagtcaaattatatgaaagccatctataactgccaaatttcttgttgttttctcaaattttggaaaaaatacaaaaaataatgttaagtataaagtaaaacaaaatgtcaaagtgtcaaattaaaaattattttatgacatgcaaatatagagtaacttgagatagattgtttaattcataaatagaagaaacaatagtgtggtttaaagagtatgtgaggaacagagattttatatagtcagttgaaaaaattatactgaaattattttgctaagttagactcctatagggcagtaaaaccatattttttatagttatcttttctatagaacagaaatcatctgcatctctacctttaaa

SEQ ID NO: 15521 - DNA, 257 bp, Homo sapiens
ctgagcgcttgggctgaggtgagggatggctcgtttctgctgctgcggacatgcgggctgagcagctgcggactgtgtccgttttcacttagaaacaatgtactggccatagaccgcatactgtagctcacctgtctccctcggcctgtgagttaagtattattttactgatgaggaaataggcttagatgggctgaggagcctgactggctgagtccccgggctgtctgccccacgccgtgtccagtggtttcatc

SEQ ID NO: 15522 - DNA, 530 bp, Homo sapiens
atgtgcaatgggcataacactgttaatgtaaagaaaatggcttttccattccctaaatttagggttaagcttagaaatccatctcctttcctactatttttaactcttctccccatgcaatgatagaaacactgcctgtgaaaaagtggtgctaatgctagagatttttgtagctgtcatgacctagtctaggaagcaaagttaaaaaaaaaaagtttttactgaaaatatgtaatctcttgctggacacaggatatttgattttatgtccctgacatgtgttcttccaatgttagtactaaaaaaaacctgtaaaatctaggccaggtgtggtggctcactcctgtaatctcagcactttgggaggctgaggcggttgaattcctgaccatgtgatccgcccaccttgggttctcaaagtgctgagattacaggcgttgagccactgcacccggcctaaactttgccagttctatagtaccaaaagagtacctttaaaatacaaatcatgacactctaagagcttagag

SEQ ID NO: 15523 - DNA, 383 bp, Homo sapiens
agattcagagtctaggatgcatctctaggttgttaagaccccaatcacacatatatgtttttcttctcctaccccctgatatttaataaaaataaacatattattaaggagaaacctgtttaaaattggtgtcattggtgagaggtagatagggaaagaagcaactactgatatttaataaaaataaacatgttatcacacaccgggacctgtcggggtgggggacaaggggagggagagcattaggacaaatatctaatgcatgcggagcttaaaacctagatgatgggttgataggtgcagcagaccaccatgacacatgtatacctatgtaacaaacctgcacatcccgcacatgtatcctggaacttaaagtaaattta

SEQ ID NO: 15524 - DNA, 496 bp, Homo sapiens
ccttttatttaaatcaggcagtgtagtaattgctcaagaatacagtcatgaaaagacttacttcccatgtctttgtggagcctatggtagggtagttaagtagataaaaacatcttaggatgtggagatgttattgcaaggaattgtttagtaaatagtttcaaatatggctgaaaataagagattaaaattaaagttaattgagttcaataactcaaatagtttattgaggcattactatgggttttgaggcagttgttttagggagttatggcaacagaagctatattagtacatcagtaagaggaaagaaggacatcaatatttaatgtacagtcccctccgtatatgcaggggattggttacaaatccatctataccagaatccatgcatactcaagtcctctggaatccacatataggaaaactcagtcctgactatacatgggttcctcatccttcaaatactgtttttaatccacatttggttggtggc

SEQ ID NO: 15525 - DNA, 447 bp, Homo sapiens
gctatcatattcttagaaaattataggttgaaacagtcactgaattgccaagagacggatttgcttgtctgtctggtgcccagctccaactgggcttacatggctagggaaaagaagggaaatttcacgtagtctaggattttattttagtcagataaatactggatggagtatttagtcagataaatacagtggatggagatacattggaccaccccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtcttt

SEQ ID NO: 15526 - DNA, 177 bp, Homo sapiens
cctggaaatactgtgttgctattcccaaggttagtttcctatataattgacactaattcaggcccaatcttctccggaatagtctaactgtcctctcgatatgttcaaatacatcaggagttctgcagttttcatccccttggtgatctctctcctggagcatcctgactgtctcca

SEQ ID NO: 15527 - DNA, 2070 bp, Homo sapiens
  misc_feature (441)..(441): n is a, c, g, or t
  misc_feature (1309)..(1309): n is a, c, g, or t
  misc_feature (1815)..(1815): n is a, c, g, or t
  misc_feature (1973)..(1973): n is a, c, g, or t
cctcccactccagtgcagccagcattgtcctggggccaccttggcaccacaggtttcctccctggcaaacctgcatgacggccttgcgtgccctcccccagggccaaggcgctgttgctgaactgaagtggcaacctacccggtcagagctttaagctgcagctctgatgccccagggacctctcagacccccctgcccagagcaggcagcccggtaagccctcctcctcttcccctgcagcctcagggctggagccacagctgggagggctcccagatcctgaccatatcctcccagaggctgagccaggcctgggcactgtcccctcaaatgtgagaatactgggcagggggaggggagaaaggagggaatggagggctgagcctggaggcatgaaaggggcaacctaggcagcggtatgggggagtgctcagagcttngagtcctgtggaaggcagagaactgccccagcccctgcctctcatcccccaccctctgtgtccctggccgagaggttcctggaggacatttttccagcaaaagagggagggtggtgtctgggcctagatccttggatgggcttttctctgcctgcttgtggggtgcctagggcgagtgggcttttggagacaatttctggcctaacctgacttggacagcagcccccagaggcacagctctcccctcaggcatgggggcatgattccacctcgctagcccacatgtgttcttcacggagggctgctggcccgtctccctggggttaccctgagcagcagagctgtgtttgttgagactccatggggtggagggattgcgatgttgtcctctcagttcccggggctgatgtggaagctcaagggcttgccctggattcttcagggtagccctgccatccctagtgagtcagtgagttgggaggttgggggctggagaatcaggtagggaggacacagctagacctcaggccctgatgggaacgtactaggctccaagtgggacctgccaggagacaagaattgatgacagccacacctttggagtctcaagccctctgccacccatgcggtggcctagttcaaatgacaggaacacaaggtccagctggcccaatgggcaggtagagggctgcagccagggctggaactggccttgcactgcctctgggcccttctctacccacccagtagtattgttcaagcccaggagggaaaaaggccagctcagggttaatgttacctcagcaagtagctgagtggcactgagcctcctggtagccactgtaaagaaggacacagaatggtttgngggcattcgctaggaggaaggaagcagatggatactctatggagacagaatgtcctctgtgtttgctctacaggaacgggttgtcaaccttctgcagggccaggaattgtcatgaggctgtagtaggcagcagagcttggcggggtgaggcgagatcacaggtataggctcagggcctggattcaaatcccctgggctgccacttgttggatgtgtaaccataggcagagtaaggacctgccatagcaaattaccacaaactcagtggcttaaagcaacagaatagttctggaggctaaaagtctgaaatccaagtataggccaagccacactccctttgaggactccaggggaagatccttccttgtctcttcagcttctggtggctcctggcaatccttggccttccttggctgctgctgcatcactccagtctctgaaaccatctaccctatgtgtctgtgtggccttcacatggcattccttatttttgcagtggggtctcnctatgttgcccaggctggtcttgaactcctgggtccaagcagtcctcctgcttcagcctcccaagtagctgggattatgagtgagtgccaccatgcccggctcacatggcctccttgtaataacgctagtgcctgggtgcggtggctcacgcctgtantcccagcacttttggaggctgcggtggacggaccatgaggtcaggaaattgaggccatcctgtccaacatggtgaaaccctgtctctactaaaatac

SEQ ID NO: 15528 - DNA, 310 bp, Homo sapiens
acttccttctatatgaagcatatatttgttctagaggcattacaggtccaactccaaacatgtaaagcagaatgcaaaggtgaatgcaaattgtggtcataagccaacttgttttgccatgtggaaaatatggaaatagttgctatgcattgcacaaaacatctgttgaaataaggctttcaatttgaatgcttcaagatagactgtttctaaaacccaagattgcctggtgagcaagcagatgggcaatttagacaatcttatactagctcatcatcgcttctgaaacacggcttcattggcaattgta

SEQ ID NO: 15529 - DNA, 451 bp, Homo sapiens
ctttatccggccctacccacatcctgctgattggtccatttcacagagagctgactggtccactttacagagagctgattgggccgtttttcagagagctgattgatccgttttgacagagtgctgattggtgcatttacaaacctttagctagacacagagtgctgattggtgcatttacaatcctgtagctagacacaaaagttctccaagtccccatcagattagctagacacagaacattgattggtacgtttacaaccctttagctagtgagaaaagtctccaggtccccacccaacccagaagcccagtggggttcacttctcaatggtactccctgcaggactttccggcaccggcagcccagagggagctcgtcccccatcaagcccagcaggcgccggctggccacacctaggcccaccaagcctgcacccacccagaaccc

SEQ ID NO: 15530 - DNA, 208 bp, Homo sapiens
ccagttctggccgtaccactttctagctgtggactcaagggagttgtttaccttctgtcagtccatgtttattcatctgcacaatcaatgcgtagaaccatagcccttacctcacagcgtttccgggaggatcagatgacacaatccgaggaaatgaaccattattgctacttactgtcactgctttcttctgaggccaacgtttggg

SEQ ID NO: 15531 - DNA, 464 bp, Homo sapiens
aattagctgagtgtgggggtgtatgcctatagtctctgctattcaggaggctgaggtgggaggattgattgcttgagcctgggagctggagggtacagtgagccaagatacaccactgcactccaatcttggtgatggagcaagaccctgtctcaaaaaaaaaaaaaaaaaacaccaaaaagcaaagactaatcccccctaatatgtaaagagcatccatgaattgataagaaaaagaccaacaacagaaagatacagaatttgaatgtatagctcatataaagcatgtaggaatggcttgtaaacatatgtaaaatgttctactcactgcttattcatttaataaatatttaactccctgtatatgctcttggaactatagaatatagaactgaccaacagggacaaaaatctctgttcttgtggaacttagcagggaaatgcaaattaaagctatgttgttt

SEQ ID NO: 15532 - DNA, 412 bp, Homo sapiens
tttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgc

SEQ ID NO: 15533 - DNA, 362 bp, Homo sapiens
tgattggctctagcaactaaaagtccaggggaaggactggctccagttacacttggattcagcactcaaaacactgcattggcactcacactttttctttcactattgtgttgttctccatgctggctttatgttgagccactacatgttggccctagctttagaaattctcaggttcattcaagtttagcaaaagaagtattagaatcctttcttgcatcctcaaaaatcctcagattcactcgaattggaccaatttaggtcacatgcccggccctgaagcaatggctatggcttgtgatgtggtgattggtttcatagatcaaactaaaaagtagaggttgttgccagatccacagaca

SEQ ID NO: 15534 - DNA, 943 bp, Homo sapiens
ggagatctgagtgactaagccgctatcattgttgtgactagagctctgttagttgaaggggagtgagagggaatttgcaatactagatttttacccatattagagttgtgactagagtccttgagtttacctcctctcttccaaccttcaaatttattggaataacagaagaaattttctagagtaaacaatgtaaaatagaagatttttattttcagcagggtggtggactatatctattctccaggtgcagtgcaactaaaaatgttaagagaacataagcatgtggttgagctggtggcaaagtaaaacagttccttggaggccagacatgataagaaacaaatccaaagcaaaagaaaacattttaaaaaacagaaatcaatgaaattgaaaacaggaagtcaacacaaccaaaagctatttctttgaaaagataataaaattaataagcttccagacaggctaacttaaaaaaaaaacaacaacaaacaaaaacaaacaaacaaaaaaaacgagagaaggcacagattgctaataccaaaaatgatagaggggacagtactgtagattccatgttcatagataggaagactcaatattgttaagatgtctgttcttcccaacttgatctatagatacaatggaaatcctattcaaaatcctaacaagttattttgtgagtaccaactaactttctcccatgaattatgaactttcttaatggcatccagaaggctaaacttcctaggttttcatagctagagaggagccagggaggagacatcaaggcctggcttcaaagcttcaaaggacaggctgactctcttgttagagtttaatggagctggtgactttgaaggcaatgctcatttgccattctgtaaatcctagggcccttaagaattatgctaaatctcccctgcctgtactctataaatgg

SEQ ID NO: 15535 - DNA, 310 bp, Homo sapiens
tgggtgattctggtcataataaactattttcaaactaggaaaaagtatccaaatgctagagcacataatgagttcagcttggtcagttttgagacagataagcataaaaccctactagaaaaaaataatagtcaaacctaaagctttaaaaaatgtgagtcacatcacttttctccaggaaaggcagaacgtgctcagggtggaatttaatcaaaaatgtacccagaacaatttcccacaaagagctgtaatactttgcagcaaggggcattaataaactctaatttttaccgaaagtcaagagacacac

SEQ ID NO: 15536 - DNA, 401 bp, Homo sapiens
gtcttaccctttaatggagttttctccaggattctgtgcttggcctgctgttttctccctatctgctggcctgtccttatgggtaaggagagatggatttagctatggcctctagcacatgaatcctaaatctttagatctgaactgtctctaaaactggaaagttacggtctgaatacttattggacatcttcaattgaatgtgccaggcactgcaaaacaaaaatgttcaagaccaaactaataatctctcctctgaccagggtagctctttttgctgacttcttatttcccaccatgacactagcattctccaaatgcttaggcttgatgttttgatcatttttaaaatttttactctctctacttatattctatcagttgctaagtcctgtaacttc

SEQ ID NO: 15537 - DNA, 630 bp, Homo sapiens
tcacacattatttacagcaccataacactagacccagcctaactgtcctgcaacaggggatgggtaaaagggatgatggcgctggaggttagccagtgatactatgcagccattagcaagcatgcttctgaagaaaatgcaataatttgggaaagtactcacaacataaaatagagtaaaaaaaaaaaagtaggacacacattgcatatatagtcagtcttatttggcagaaggaatctatacttatctatacttaggaagaaggactaggaaggaaaactgggaaaacgtacggtggctctgtctggcgtcttgaaggtcatggcctatccaattgggacttttgacaatgtctggagacgtttggattgtcacgcctggggaggggggtgctactggcaactagtaggtgacacccagggatgacgctgagtatctcgcaaggcatgggacaccacagcaaagaagtgctcaacttgaaaacatgaatcgtgctgaagttgagaacctttggtctaagatcatgggtcattttattttctttacacttgttgttatttttcaaatttcctaaaatgaacacattttacttttatagaaggcagatacaattttttacttaaaaaaaaa

SEQ ID NO: 15538 - DNA, 343 bp, Homo sapiens
agggtctcactctgtcacccaggctggagtgtagtggcacaatctcggctcactgcaacctccgcctcccgggttcaagcgattctcctgcctcccaagtagctggtattacaggtgcccatcaccacacctggctaatttttgtatttttcatagagacagggtttcactatgttggctcagctggtctctgaacttctgatctcaagtgatccgcccgcctcggcctcccaaagtgctgggaatacaggtgtgagccagcgcacctggctgacatccacaacttaaggctagaaatgtaaaatgttggttcgcagtgtaacaagcacattccaaagaaaac

SEQ ID NO: 15539 - DNA, 343 bp, Homo sapiens
gaatatgtcatttgcatattaaattacttattgcaacacagttcaccctctcatgagcatttatattctcaatacattcttgattttttaaaaacattttttctgttaactttgtttccctaaaaatgtgtaagagaaaggaaagtagccctaattagcgatttgtgtatccgtggttttttgaaaatgaaattgacaaaaagagacaggatgctcacttttattgctttttgcaggagggttcttaccctgagctggcctggccactttaggaattcacaggcacgctctgaggggcctgtgagtagggaggctctcttacccagaggggagaggaaggcat

SEQ ID NO: 15540 - DNA, 270 bp, Homo sapiens
gctgtggcaccccagtttacaagacgcaggcactgtggggtactggtaagagacagtaactatgacaacatgactgtctttctgggaactcgtgagttttgactattcttgatagatttggtttggaaggtgaaatggttttaaagtactgaattgaaattatgtaaacttatgcatccaatttttaaattaaaataaatgtaaagaaaaactaaaaagatgcataaatattgtagatgttgggactgatcaaatcatatttgattgtcc

SEQ ID NO: 15541 - DNA, 993 bp, Homo sapiens
aaacttcagtctttaagagtctgttgtgcagcggagtaggctttaaagaaacagtgcagcagtggtttcagtaataatcctcacttccatcagaatctgcctgggagggagcttttacaatgtacaagtggtgagaatgtttccaaggtgctaattatggacatagattctttgtgtgggttgatagctaccaatgggacagtgtagaaacaagtttccacctttctaaaaccagtttggtacatatctttttaaagatcgctttataaaaacaaaaagataacattaacatttattgaaacaagtcactctgagaagaccaggaacaaagttctcttggcagatctgggtgatgtgtgtgtctcacatttttatcatgtttttatgactgttttatcttgcaggtaagctttacagctttcagaggagttgtagtacactacagaaatatgtcttctttccaggttcaaaaagcaaaatctgattggcattgcattgaattattaattaaataaatttattaattggcattgcattgaatttataggttaattttgaaagaatgtggcgtctttgaaatgctgattttttttcactttaaaaaaatgacttttttttttaccactgatagtatttcatatggtccctcagtaatatttcttagagatggttaaaaataggttctgagtcatcttaagcatatttctaggaatttgttttattgctgtcatgaatataatggttttgctccagttcatttcatagtttaacatatcaaatattaggtatcttaaaaatcacaaatgctatttcaccctgcaggttagcagtattaaaatagaatcatcaaatcccccatcagtgggggcgggggggggggttgtagaaacagtctgatatggtttggctctgttccccacccaaatcccatctcaattttaatccccatgtgtcagaggagggccttggtgggagatgactggatcacgaggg

SEQ ID NO: 15542 - DNA, 271 bp, Homo sapiens
tagagacgggtctcactatattgcccaggctggtcccaaactcttggcctcccaaagcactgggattacaagtgtgagccaccgtgccctgcctcttcttcttttgagctagtcggtttctgaggttgccttctgctctattgttgctgtggttttcaggatgtagttagggccctacaggaaagtgcctggtggcccttagggcctggcttcacctccctctgctcctccaagaccttggccccatggatatttgtcctgggtctcacca

SEQ ID NO: 15543 - DNA, 516 bp, Homo sapiens
ttttgatgggaggaaacaaaaagatctgatcactctctctcattcatgcggaatcactgactgttgaatgaccaaagcagtcaaagccaaaatattcaccttgaagcttcaataaaccagattgagtatccataataactaatttaagtaattttatccccattctctgctaaatcatatttcataatataaaatgtaaccacttccctctatccaaagcttttggtcagactctccattgagttagagaaattggactttggcaaaaagcaacataaagattattgttgttcctagaaccattgttgccatggacccctcatttgctcctcaactttttcaaccaaattatagcgggaaagattcctgatgaagccaagactgcaaacaggaagaatacctagctagtaaactatgcaaaatcacaacaaagattcatttataattccatgttacagtgtttgatagtcctaagtatttaatattggtatattatgtcacagccatgaactgtca

SEQ ID NO: 15544 - DNA, 481 bp, Homo sapiens
gggattagctttgcattatctaacccatttattttaaatctgccaggaaatcctctaactttccttcctttttgtttcagtaagtatcaggcagcttcaccatacctgagtccttttgtcttgaagctgccacagaaaaatcttacagcaatcattgctgattagaaactgtttcagacaatcagcatgggtgttatttaccaaattccccccagagtcctaggcctcttctccagaaatatctgatgatgaagtgaggggagggcaacggtgctacaaaacacggaacagaggtaaagagaaggcactactttcttgccatacttgtaaatgattgctttgttcaaacataaataatcttaagtccaacaccaaatacctgttactcctacatcaatctcattagtggtttaagacacagtactagaattttcattttttaaaatcccttggcccttaaaaaaatttacagaacacaaag

SEQ ID NO: 15545 - DNA, 521 bp, Homo sapiens
ggtattttgtggatgtttgcttctcctagtttccttctagaattaaccccagctgtgaagccagctttcttctcaggtcctcgttgtgtaactttaagtggcgtggacgcagagaatgaagcagatgtgagtaagaatgaagggctcaggcatcctcaatatccccttttgtgggagagagggagagagcagagtggttttgctttaccaaaatttggggctcctgtttctttcctcagacggctcccaaagacattccctttattttcctgggctgtcctccctccctgggagggcagaaggaggagggcaatgcttcatgctgtagaaaggacacatttgttcttccttgagcagtccctgggaaccttctggagtgaatgcctttgagcatcctgagtggcacatgcaactgttggcacggccaagggggagagttggagacaggcatgaagcatttgaatggtaggaatcttaaaatctgtctctgggggttttatgtatgaaataagtatgaacgc

SEQ ID NO: 15546 - DNA, 437 bp, Homo sapiens
acatactcgggctgtctcaatgttttcctacggtatttaagtgccagtttatggaggttttaaagaaaagattttctcagacgagaagagcttataatatacttcctgcaaacattctagaaaatgtaggtccttatcagtcaaccttcagaatggggaaaccacaaaataagtgaaattttgttaacctatctaagtaaacattaaagagttgcttttagaaatgacacaatgtaaagagaccatcagggtctaaaacctcattagccagaactggaaaatgagcttttaaatacaggtaaaaagtaaataagcaatttatcctctactttgttagagtacagaaatagtatttcaaagcaaccactagcagaataaaagactatacttaactttgaaatcaccaggaaaaaggctaggaaaacagcccacaaagc

SEQ ID NO: 15547 - DNA, 439 bp, Homo sapiens
attcattttaacaatcatgctgtttctgcttcactggacaggtgaaattaagttaaactgagtctcaaggactgtcttgaagaataaaataagtcatagcagtactatagctcaaataatgtcataaatagagagaaccagttttatctgccttgtctccatgacaggaagttttaagactgtttgcatcctatatgagcctcaatttttttaaccaactggtaaagctgccttttcctccacttccatatatgcttttatagaaagatgtatattttcttaagagatcaaatcagggatgaattggactttacaaatattgtaacagtaaatcgcaatcataatttgattcaaggatctttcaaaattagagaataccagttattgatagctgctatctagatagcaacaatataccattacaatgtttctactactt

SEQ ID NO: 15548 - DNA, 383 bp, Homo sapiens
aaacattagccaggcatgatggtgggtgcatgtaatcccagttactcaggaggctgaggcaggagagttgcttgaacccgggaggcggaggttgcagtgagccaagagtgcgccattgcactccagcctgggcaacaagagcgagattctgtctcaaaaaaaaaaaaagagttgtcaaattgccaccccaatgctgtggttctctaacctgtgtaacaggatcacctggagggaccctacccgagaccttccgattcagtcctgggggaaccctaccccagatcttccgattcagtcctggggggaccctaccccagatcttccgattcagtcctgggggaaccccaccccagaccttccgattcagtcctggagggacccta

SEQ ID NO: 15549 - DNA, 308 bp, Homo sapiens
ggtgccatggtgtaataaacaccagctttagagacagacagaccaagctctgagttccagctcagcctcttagtctccatttattcacttgcaaaagggaaatggtaacagtcttgtttcatagggttgtgataaaaattaaataatcagctattaagacttatttcttgagcacctatcatgtaccacaaactgtggaaaacaagatgagcagaaacagagggagctaaatccagtggggtaaacatcaccagatggacataaactcactggatagcagtctgtgatgatggagttgtggcatggag

SEQ ID NO: 15550 - DNA, 1327 bp, Homo sapiens
aatcgaagaagccccggaagtttcgaactaccaccggcgtgcgttcgcaggtagatcgcggtgccagttgccatggagccggccgggccctgtggcttctgcccggcgggggaggtccagccagcgcgttacacctgccctcgctgtaatgcgccctactgctcgctgcgctgctaccggacgcatggcacctgcgcagaaaacttctaccgtgaccaggtgctgggagagctccgcggttgcagcgctcctcccagccgcctagcaagcgccctacgccggctgcgtcagcaacgcgagaccgaggacgagcctggggaagcaggcctcagctccggcccggcgcccggcggcctatcgggactctgggagcggctggcgccgggcgaaaaagctgccttcgagcggctgctgagccgcggtgaggccgggcggctgctgcctccatggcggccgtggtggtggaaccgcggagccggaccgcagcttctggaggagctggataatgccccgggtagtgacgccgcggagctggagctcgcccctgcgaggaccccgccggattctgtgaaagatgcctccgccgcggagcccgcggccgccgagcgggttcttggagatgtcccgggggcctgcacgcccgtcgtacccacccgcatccccgcgatagtcagcctgagccgcggcccagtctcgccgctcgtgcgcttccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggctctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtcagccc

SEQ ID NO: 15551 - DNA, 1187 bp, Homo sapiens
  misc_feature (79)..(79): n is a, c, g, or t
  misc_feature (88)..(88): n is a, c, g, or t
  misc_feature (107)..(109): n is a, c, g, or t
  misc_feature (112)..(112): n is a, c, g, or t
catggcacctgcgcagaaaacttctcccgtaccaggtgtggagagggctcctttccccccccggccccggggtttttgncaagggcgngctctttcccccttccttnnnccnccagcccgcctagcaagcgccctacgccggctgcgtcagcaacgcgagaccgaggacgagcctggggaagcaggcctcagctccggcccggcgcccggcggcctatcgggactctgggagcggctggcgccgggcgaaaaagctgccttcgagcggctgctgagccgcggtgaggccgggcggctgctgcctccatggcggccgtggtggtggaaccgcggagccggaccgcagcttctggaggagctggataatgccccgggtagtgacgccgcggagctggagctcgcccctgcgaggaccccgccggattctgtgaaagatgcctccgccgcggagcccgcggccgccgagcgggttcttggagatgtcccgggggcctgcacgcccgtcgtacccacccgcatccccgcgatagtcagcctgagccgcggcccagtctcgccgctcgtgcgcttccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggctctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtcagccc

SEQ ID NO: 15552 - DNA, 1012 bp, Homo sapiens
tcccacatcaagtggagttagaaggaaggtagaggggctctccggacatggacagtgcggctggcgccgggcgaaaaagctgccttcgagcggctgctgagccgcggtgaggccgggcggctgctgcctccatggcggccgtggtggtggaaccgcggagccggaccgcagcttctggaggagctggataatgccccgggtagtgacgccgcggagctggagctcgcccctgcgaggaccccgccggattctgtgaaagatgcctccgccgcggagcccgcggccgccgagcgggttcttggagatgtcccgggggcctgcacgcccgtcgtacccacccgcatccccgcgatagtcagcctgagccgcggcccagtctcgccgctcgtgcgcttccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggctctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtcagccc

SEQ ID NO: 15553 - DNA, 1060 bp, Homo sapiens
  misc_feature (79)..(79): n is a, c, g, or t
  misc_feature (88)..(88): n is a, c, g, or t
  misc_feature (107)..(109): n is a, c, g, or t
  misc_feature (112)..(112): n is a, c, g, or t
catggcacctgcgcagaaaacttctcccgtaccaggtgtggagagggctcctttccccccccggccccggggtttttgncaagggcgngctctttcccccttccttnnnccnccagcccgcctagcaagcgccctacgccggctgcgtcagcaacgcgagaccgaggacgagcctggggaagcaggcctcagctccggcccggcgcccggcggccgcagcttctggaggagctggataatgccccgggtagtgacgccgcggagctggagctcgcccctgcgaggaccccgccggattctgtgaaagatgcctccgccgcggagcccgcggccgccgagcgggttcttggagatgtcccgggggcctgcacgcccgtcgtacccacccgcatccccgcgatagtcagcctgagccgcggcccagtctcgccgctcgtgcgcttccagctgcccaatgtgctgttcgcctacgcgcatactctcgccctgtatcacggcggtgacgacgcgctgctctctgacttctgtgccacactgctcggcgtttccggagccctgggtgcccagcaagtcttcgcctctgcggaagaagccctgcaggcggcagcccacgtgctggaagcaggcgagcacccgccggggcccctgggcacacgaggggctatgcacgaggtcgcccgcatcctgctgggcgagggcccgaccaaccagaaaggctacacgctggcagcactgggggacctggcacagaccctgggccgtgcccggaaacaggccgtggctagagaagagcgagatcatctttaccgggcccggaaaaagtgccagttcctcctggcctggaccaacgaaaatgaggcggccctcacacccctggctctagactgcgccagggctcaccaagcccatgctgtggtagccgaggaggtggccgccctcactggggagctggagcggctttggggaggccccgtgccacctgccccaagaactctcattgaggagctccctagctgaacgggttaccctggtcattaataaagctgtgactggtcagccc

SEQ ID NO: 15554 - DNA, 148 bp, Homo sapiens
ctttctcatcacataattcagtaagaaataagtaacaaaaggaattgcaaatccataagcctatgaatcaacgagttaatcaaaatggcaaattataagatattttaaattggataatagtggaaaacatggatacagttaaaactgt

SEQ ID NO: 15555 - DNA, 858 bp, Homo sapiens
ggggtgaaggagtggggcaaagtgtaatttggggaaccaagcagggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaagacttgccttcctggttcttcctgggctgtggaatgggtagtgatagaatttccaagtatgatagtgcatttggttcaaagaacagcactgtagcatgggagaacctgcactataatgtcataaactca

SEQ ID NO: 15556 - DNA, 513 bp, Homo sapiens
gtctacaactaatggatctcctccttagttcctgttggatatcttgggatggggtcatgagggtagaagcgtcaccacgaggactgcttttactctcagggtcacctgcctagtaaattgtccagcagggaggagaataaatttcttttattcccatccatatgactatgtcatctacagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaagacttgccttcctggttcttcctgggctgtggaatgggtagtgatagaatttccaagtatgatagtgcatttggttcaaagaacagcactgtagcatgggagaacctgcactataatgtcataaactca

SEQ ID NO: 15557 - DNA, 902 bp, Homo sapiens
ggggtgaaggagtggggcaaagtgtaatttggggaaccaagcagggcctggagctatctccatcttcagctccagagtccttggtttctgtctgagaacaaatggcacagcatccctgccaggatcaggaacaaaaggtagaaatgacctccaagcagcagagaagcacatccatagaagagacaatgagaccacaggaaaaacaggtaaccatcactgaaaccctgtgggaccaggtgctgacagtttttaaggatatacaaaaggagctgcaggaagatgctcggattcgagggatgagcaactgctccatgacacccatgacatcagcacccaggactggaagcataaggcctccagattccttgatgaccccaaagttgagaagattgcagttcagctctggagagcagccatcaggaggccgtatccacaacctgaagacacagctcttcagtcaatcagcttactaccctggaccctaactctacaatcaaggaagaaggacatctctgcttccgccaggctcatctgacacctaacccacctggagaagaagactgtctcagcacagcttcagttggggaagatattagcagacatcatcactgaacccagaagagagggtggtgcccatgagtggagatgccagggtctatggctgaaactgggaacttggaaatcaagtgagacccaagcaaggaaaccaactgccaaagcaaggaaaccagcttggtttggcaaacagctgatgaaataaatgtgacgtagaagacttgccttcctggttcttcctgggctgtggaatgggtagtgatagaatttccaagtatgatagtgcatttggttcaaagaacagcactgtagcatgggagaacctgcactataatgtcataaactca

SEQ ID NO: 15558 - DNA, 638 bp, Homo sapiens
tcaggagttcgagtccagcctggccaacatggtgaaaccctgtctctactaaaaatacaaaaattagctgggagaggtggtgagcacctgtaatgctagttactcgggaggctgaggccggagaatcacttgaacccaggaggtggaggttgtactgagccgagatcatgccacactgcactccagcctgggtgacagagcgaaactctgacttaatttaaaaaaacaaaaaaaacaacaaaaaaccttggccttatttgtcttactccaaagtcgttatgattgtttcctatgttttcctttaaaagcttaattcatttagttttatgtttaagtccactattcatctcaaattcatttttgtggatggtggaggtgatttttttttctttatggatctccagtattccagcagtaccatttgtgaaaaagattttcctttcctcgttggatcactttggtgttttagtcaaaaatcaaatgactgttttaagtgcaggtctatttctgtgccctcttttgttgcattgatcaattttttaatccttacatcagtactatactgtctttttagtaaggtttgaagtaaggtagggtcatttgcatgtctcttacactatcaaattttaccaaaaaaa

SEQ ID NO: 15559 - DNA, 425 bp, Homo sapiens
atccaatttatcaatactttcctttatagttagtgtattttatgtcctattagacaatcctgttagacagtcctgtcctgttaaaaaatcttgactggctgtggtggctcatgcctgtaatcccagcactttgggaggccaaggcaggaggatcacttgagctcaagagttccagaccagcctgggcaaaatgatgagaccctgtccctacaaaaaagtaaagaaattagccgggtgtggtggagcatacctgtagtctcagctactcagaggccaagacaggagggtcccttgagcctaggaagtcgaggcagcagggagctatgatcgcgccactgcactgcaggctgggccacaaagtgagacccccatctctaaaaacttttttaatataaaaacaaattttttaatctttgctttcacgc

SEQ ID NO: 15560 - DNA, 215 bp, Homo sapiens
tcacttcaattaaagactataaacaacagaaatctcattgtgtctacacatcgggtgaccttaggtcggtttgtaagtggatacaattaataaaataaaatccgtcacctttttttcctgttacattaactgaagatgcacccaatcttgaggcagcttctgagttgagaattatattgttatccaatactgttgattcattttgaatctttaga

SEQ ID NO: 15561 - DNA, 2402 bp, Homo sapiens
agcggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15562 - DNA, 2400 bp, Homo sapiens
ggcctgagtggcgaattcggcacgagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15563 - DNA, 2434 bp, Homo sapiens
agcggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcccagaagaggcgatattctccaggagtccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15564 - DNA, 2317 bp, Homo sapiens
ggcctgagtggcgaattcggcacgagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15565 - DNA, 2481 bp, Homo sapiens
ggcctgagtggcgaattcggcacgagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgctgcattgtcttccttgaggtatggcgacaagaagtgaatgcagtattcctggtgtggctgcactgtgattttgtacaagtccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15566 - DNA, 2198 bp, Homo sapiens
ggcctgagtggcgaattcggcacgagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccaggccatgtttcctgagagactgggagttgcaggtgcacttcaaaatccatggacaaggaaagaagaatctgcatggggatggcttggcaatctggtacacaaaggatcggatgcagccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15567 - DNA, 2696 bp, Homo sapiens
agcggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaaaaaaaaaaaaaaaaaaaaaaaaaaaaaaaaaaaaaaaaaaaaaaaaaaaaaaaaaaaaaaaaaaaagaaagccgagcgacgcctaatcattcgtggggcggcggagcgagaaaaagaagtagatatacacaaagcagcgagcagcagggtgaccacaaactgtgttgccgacgacaccactattcttgttgtagaacaacggggtagaaacacacgcggggctcgccacaaggaggaggagcagatataaacgcaggaaagacagccacgagtatagaccaccgccggtaaagg

SEQ ID NO: 15568 - DNA, 2347 bp, Homo sapiens
agcggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 15569 - DNA, 1120 bp, Homo sapiens
agcggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgcattcacacctttcagtctccatccttctggccgcc

SEQ ID NO: 15570 - DNA, 968 bp, Homo sapiens
agcggatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagagtgagcacaggggcccgcgggaaatggtcccatagt

SEQ ID NO: 15571 - DNA, 287 bp, Homo sapiens
ctgttggtcattttatttgtccttctctggaccttttctagctgcattgtcttccttgaggtatggcgacaagaagtgaatgcagtattcctggtgtggctgcactgtgattttgtacaagtgtaagatgatgctttcttttctgtttccagggctttctaaatcttttacgaccagtttacttttgggcatgactctggcatcctttgatactttctctggaattctcttaaactaagaacttacttttttacgtggcttttctcattagttgtagataagcgaat

SEQ ID NO: 15572 - DNA, 155 bp, Homo sapiens
tgttgctataaacttttctggcttcagattggatgatactagctctgaaagatggtaattgattttcccgacaaaaaggcctattagcaccaggaaaagagatcagaagcaagtagaaacatttctcatttttggaatgatggggttgatttgag

SEQ ID NO: 15573 - DNA, 401 bp, Homo sapiens
gtcactgggttcaatgacttcattgacaccaaactcaattctccgatattcttgtccatcaggtagtttatccccagcttgtgtgccacacagaactgttccactgcatggaggaagctcaactgaagatcgaggagtcacaaagaactgattgaattcatcagggctaaaatctccaaaaatatactgcgggctgtggagggccatggctgccggtttcaatgggactcggcgctcctccggctgctcacgctgcctcccccgccgccgccatcttctcccccgcacatacacccatctatgactatttcaataactcctataacagatggaatttttgcaagttttagaataacaaataacattaaaaatcgttatgaataaacattaatttacctaaa

SEQ ID NO: 15574 - DNA, 280 bp, Homo sapiens
cccttatccacagtccacccttatccactgtccaaccttctccacccttctctctgccccagaagctgctgattcacatgcactctatcaacaggcttcattgtcctcttgcttccagttgggtgtgatcaatgtgaggcattctcaggagactggaggacaaggacaaagtgagatggagataagtgtcctagttatagtgggttatcatggttagatggcacacttgtatccaatgcctctgtttctgtcagtttctcaaagcagctacttttcctgg

SEQ ID NO: 15575 - DNA, 433 bp, Homo sapiens
ctccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctggtgtctggtgt

SEQ ID NO: 15576 - DNA, 745 bp, Homo sapiens
tctcagcagttgccctgaggcaagtggaaaggcaggcagtgctctggggtcaccgagaaagtctaaaaacaggaggctgaaggtactgtgatggctttaaaaatggccaccttattaaatagggattgtatcaatattgaaatgaagacaatctttccaactttgggtgtttcacttgctgttttaattgtttgtttttaacactttgtaggtttgtgttttcataatctttaatttgaaactcatgtgtcctcatggatcgtggatgccttcatttcttgagctctcaatgcagacatttaaatggctgcaatcagtagagtgacccgcggatggcataaatgcacctccttttcttggccttggatctatgggtctgggattgtggtcatctcctcaatcctcaaaaagaggctgaatcaatgtggccgtgggtgggaacttacatacagaacccaatgaagaacttgactgtctaaacaagggggcctcgcatggagctgtaaagcatctaacaaatatgaaaaatgtgaagttccaaggtccaagaagaaaaataatgatgtttctgaaagtgatgataaataattacttttaaagtgctgcatatttatacaattgagagattatttttgtaaatgcaatgtctgtgagctgggatacatgggcagtgcttcagacatttaaaaatcactttttactcctagggagatgccaataaacagaactcttttgtttcttctga

SEQ ID NO: 15577 - DNA, 1543 bp, Homo sapiens
gagaaaggagaggagggaggaggcgcgccgcgccatggtgtcctgcgcggggccagggccagggccggggccgggccaggccgggccatgagccgcgccgggagctgggacatggacgggctgcgggcagacggcgggggcgccggtggcgccccggcctcttcctcctcctcatcggtggcggcggcggcggcgtcaggccagtgccgcggctttctctccgcgcctgtgttcgccgggacgcattcggggcgggcggcggcggcggcagcggcggctgcggcggcggcggcggcagcctccggctttgcgtaccccgggacctctgagcgcacgggctcttcctcgtcgtcgtcctcttctgccgttgtagcggcgcgcccggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaaggcctttggaaagacttgaatatgtatttaattccccccaccccctgccaatggtggcaaattttgtgaattgtttttctctcttccccttatctggctctaaaaccttctgctgcccaacctgactttgtagttctgatttttacttgtttattattggttttgttcttgcctagggtttttaaaatatctgtttttaatgttttgtttctccctccaggccagtataaagggacttgaagtattttttaataatctgccccccaatgaacttcagaagtgccattctgatttaagggtttttttaaaaaattactttatttgttcattcccagcactgattatcttcataatccattaggacagaatgg

SEQ ID NO: 15578 - DNA, 421 bp, Homo sapiens
acctgggaggtggaagttgcagtgaactgagatatcgccattgcactccagcctgggcaacaagagcgaaactccgtctcaaaaacaaacaaacaaacaaacaaacacacacacacacacacacacgaaaaagaaaagaaaattaaaaccttttttctgcatggtggcagaccctaatgtctgctcacccaatacccctggccccatgctgctggcaacacccacatgatctgaagtggctgcctgggaggttcctctgaggaacgttccctggccacaggagggagagtaaccagataagcccaccaccacgatcacgttcccctttgcaagtgacacaatctcagctaagggaatctgaaggtacactgaaccaggaccattgtggaaaaggtgttccttcctcacagcaatggatgct

SEQ ID NO: 15579 - DNA, 567 bp, Homo sapiens
cactccagcctgggggacagagcgagaccctatctctaaaaaacaataaaagaaatagatgtgtccttcaccctcatggaactgccagtctagccttcaacctggtgactgtagaaatgtgtgattagatgctatattgccatgttgagtgtcacccctgagaagcagggttttttttgagaaggtaggatgggggatctgactgtgggaccaccagagggaaaagcacatgtaaaagctgcgtgtaccaactggaggaaatcggagacgtgatcagagaaccagagtcaaccaggggccatgccgtacagggtcctgttaagatctgtgacttttttctaaacgttttcttctggataacatctaaatttctagttccaaatgtgaaactccaagggcgttctgtgctaaacattttgcatgtattaattaatttccaccacacaacattgctgtgaattaagacagtttctaagcatggcaagaaacccagaaatcataatggaaaaatctgataaatttaacaatgccaacatgaacctctgtaggaaaaaaaataccacagac

SEQ ID NO: 15580 - DNA, 358 bp, Homo sapiens
tcatccttgaaggacctggcccattcattcccatgtgcagagtaaggatgagggcagctcatgtcagatgagtggggaggcaactggacctccattcaaggtgctgggcccaggcctggtacggccaggcagggaggagcacctgattctgggtgtattggccatttgtgacagaacccacgccacaccctacgcccagccctcccctccatttcctagggcctcctcttccacctgtgttcaatcagagtggagtgcctgtttcttcactgcattattctttttttttttttttttttggcactgcattattcttaacaatcataggactgggcccagcatggtggctcacgcctgt

SEQ ID NO: 15581 - DNA, 387 bp, Homo sapiens
tattaggctttaaaaacaagtatgtgtaaaaataagattgtatataaaaatgtgaattatgggccattacaacatcctttgtgagaaatgtgaatttcaaggaaatagaagaatggctaggtgctagcactgattccaggcttttgtgtggttttgtaggtaaagaattgggacattgggaggccgaggtgggcaggtcacctgaggtcaggagtttgagaccagcctgaccaacatggagaaaccatgtctctactaaaaaataataaaattcgccatgcgtggtggtgcatgtctgtaatctcagctactttggaggctgaggcaggagaatcgcttgaattcgggaggcggaggttgcggtgagctgagatcgcgcctttgcac

SEQ ID NO: 15582 - DNA, 291 bp, Homo sapiens
tagcatttattgttcacttgctgtgtgctgagtcctttgtattcattactcctaggcaattcttctaacagccctatgaggtaagaatttcaaaccccattttacataccagtaactggaactccaaggggatatagataccttggccaaagttttacagtgggaaatatcagaactaagacttgaacccatctgtctgactccgtagtgtgcttaaaaatatattttacttgtttacacttaatgtttaatatattcagttttaaaggtaatgcacatttgttatggaaa

SEQ ID NO: 15583 - DNA, 3202 bp, Homo sapiens
aagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggattgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15584 - DNA, 886 bp, Homo sapiens
aagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttcacttcgtgtgggcttcctgtcctcgctgctgcctcagagtaagaagagcccctcaaggttgtcgcctgctcagggccctcctcaacctcagagctcggccaagaaagagtccttcggtggtcaggtaagcacaagtcctgcc

SEQ ID NO: 15585 - DNA, 434 bp, Homo sapiens
cagtgtcttcctagacttagggctcccaggtgagctccccccagggactcctgagcctcacttctgacctggtgaaagaagctgcctctgaggcttagaagcagcctgacctcttgggcaggggcagctttatggcgctcattgggtcctgggtgcctgcccttggcttccagaacagctgtcagcctgagtagagggtgagggggcctcctgctgcaggcagattccttctgcagagccctggccaggatgtgagtggccgtgtctcattgcctcagacatgcagcagcatgagtgcgcgatgagctggagggcccactacggggaggtctactctgtggagttcagctatgatgagaacaccgtgtacagcatcggcgaggacgggaaggtaggcggctgcaggattcagataagagagcaccgggatgaca

SEQ ID NO: 15586 - DNA, 3089 bp, Homo sapiens
aagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggattgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15587 - DNA, 3163 bp, Homo sapiens
aagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggattgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagtgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15588 - DNA, 3175 bp, Homo sapiens
aagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggattgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcaaaaaaaaaaaaaaaaaaacaaaaagcaaaaaaaaaaaaaaaaaaaaaaaaaaaaaaaaaaaaaaaaaaaaaaacaaaaaaaaaaagaggcgggggcggggcagcagaacagcactcaccgcgggggggggcgcccaacgtccggacggaccacgatgctgggaggaaaaggcggcgggcccacaaacaagaggagcgcacgtaaacaaaccaaccaggcagagccggagcgacgcagctacaaccccgacacgccgccggaggaaaacaacacgtacgataggaggaagattagaggaaagaaaaacccacaacaggggggggaaggaacaaaaggggcgaaagccaacacaagaacaagtcaccagcccgcgcgggcaacaacacaaagccagaagggggagagagaggggtaaccaaaacagacaagtaaaccgagcgcgagcagaacaagatggccgcccacgcagatcgatgacgcggaaaacaaatacacgagcggggccggatacaacagcaagcggaggacaagagacgacagcgaaggcgcacgagacgccgaaccaagcagacgacacggacaggcagacagagcgaagcagaaagcccaagaagccgagccaaggagaacagaagcgacacacgcagaaacagaaa

SEQ ID NO: 15589 - DNA, 2361 bp, Homo sapiens
gtgacaacagacccctaaggctcagatcataagttctggcatttcaggattcaagatgcacttgggggccacccagagccccataatgtctgaagttcctctgttatttttttttattgttgaactcctcctcctgcctctctgaggaagcacttgcaggagcatccggaccccagggctggtagagagtgccctggccgatgcccccagcctggattgtgtctagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggattgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15590 - DNA, 1867 bp, Homo sapiens
tggaacctaccccccaccatcaaggccgcaggctgccaagtgtggtccgcggggctggtcctttcccaagcctaatgccccatctcctgtgcaggatccagcctcaggaccaaagtgcaccctccctctgtgggcaggcagagggtctgacccaggcccatgtgtgttgcagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcagctccagttctccctggatccagaacccattgctatcaactgtacagccttcaatcacaacgggaacctgctggtcacaggggcagctgatggcgtcatccggctgtttgacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15591 - DNA, 1695 bp, Homo sapiens
cagtgtcttcctagacttagggctcccaggtgagctccccccagggactcctgagcctcacttctgacctggtgaaagaagctgcctctgaggcttagaagcagcctgacctcttgggcaggggcagctttatggcgctcattgggtcctgggtgcctgcccttggcttccagaacagctgtcagcctgagtagagggtgagggggcctcctgctgcaggcagattccttctgcagagccctggccaggatgtgagtggccgtgtctcattgcctcagacatgcagcagcatgagtgcgcgatgagctggagggcccactacggggaggtctactctgtggagttcagctatgatgagaacaccgtgtacagcatcggcgaggacgggaagttcatccagtggaacatccacaagagtggcctcaaggtatccgagtacagcctcccctcagatgccacgggcccctttgtgctgtctggatacagcggctacaagcaggttcaagtccccaggggccgactcttcgcttttgactcagagggaaattacatgctgacatgttctgccacaggcggcgtcatctacaagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15592 - DNA, 1782 bp, Homo sapiens
aagacgctagcgctgcgatggcggaggccgtggagcgcactgacgagctggtccgggagtacctgctcttccgcgggttcacgcacacactgcggcagctggacgccgagatcaaggcggacaaggagaaggggttccgggtggataagattgtggaccagctgcagcagttaatgcaggtgtatgacttggctgcccttcgggattattggagctacttggagcgtcggctcttcagccgcttggaggatatatacagacccacaatccacaagctgaaaaccagcctgtttcgattttatcttgtctacacaatccagacaaacagaaatgacaaggctcaggagttctttgcaaagcaggccacggaactccagaaccaggctgagtggaaggattggtttgtcctgcccttcctgccatccccggacaccaaccccacctttgctacctacttttctcgacagtgggctgacaccttcattgtgtccctgcacaacttcctgagcgtcctgtttcagtgcatgccagtccctgtgatcctgaactttgatgcggagtgtcagaggactaaccaggttcaagaagaaaatgaagttctgcgtcagaagctttttgcattgcaagctgaaatccaccgactgaagaaagaggagcaacagccagaagaggaagaggccttggtccaacacaaattgcctccttatgtctccaacatggaccgcctgggggactcggaacttgccatggtgtgcagccaaaggaatgcctccctctcccagtcacttcgtgtgggcttcctgtcctcgctgctgcctcagagtaagaagagcccctcaaggttgtcgcctgctcagggccctcctcaacctcagagctcggccaagaaagagtccttcggtggtcagggcaccaagggaaaggacccgacgtccggagccaaggatgggaagagcctcctcagcgggctggccactggggagtccggttggtcacagcaccggcagcggcgcctgcaggaccatggcaaggagaggaaggagcttttctccacaaccacttcccagtgtgcagagaagaaaccagaagccagtggcccagaggctgagccctgcccagagctccacacggagccagtggagccactgactcgggcatcctcggcaggccctgagggtggaggagtccgccccgagcagccctttattgtgctgggacaggaggagtacggggaacaccactcatccatcatgcactgcagagtggattgctctgggaggagagtcgccagcttagacgtagatggggtcatcaaagtgtggtccttcaaccccatcatgcagaccaaagcatcctccatttccaaatcaccgctgctgtctttggaatgggccaccaaacgggacagactgctcttgctgggcagtggtgtgggaacagtgcgtctctatgacacggaagccaagaagaatctctgtgaaatcaatatcaacgacaacatgcccaggatccagcctcaggaccaaagtgcaccctccctctgtgggcaggcagagggtctgacccaggcccatgtgtgttgcagaatcctgtctcttgcgtgcagccccaacggggcctctttcgtctgttcggcagcagctccgagcctcacttcccaggtggacttctcagcaccagacatcggcagcaagggcatgaaccaggttcctggcaggctgctgctgtgggacacgaaaaccatgaagcagcaggcaggtacgggcctgccctgtggctctc

SEQ ID NO: 15593 - DNA, 921 bp, Homo sapiens
  misc_feature (93)..(93): n is a, c, g, or t
cccccccaaaaaaatttttttttggggggggggaaaaattaagaaaaaaaaacccgggttccccccccccccccctcgcaatgctgtgttttnagaaggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccccgaactgaacctctccaggctctcctgttgctttgccatggagccaggtcagctctctgtctgttctgctgggtaacaaggtttggcagttcctgtttctctgggcttaagtcaaggccacagaattctttttcttccctgaaagctggcagcttttgttacagaagattctcaggatgaaggcaggggctgaggcctctgctactggctgcccctttccatccagtggctgctgtttcccaagacgggctaagcgtttcttatctgaaatgcttgggacaggagtgttacagattttggattttttcagactttggaatatttgcatatatacataatgaggtatcttggtaggtctcatgtctaaacatgaaattcattcatgttttatatataccttatacatgtagcctgaaggtaactctatacagtattttaaataattttgtacatgaaacaaagtattgattgtggtcaggtgtggta

SEQ ID NO: 15594 - DNA, 576 bp, Homo sapiens
gtgggctgacaccttcattgtgtccctgcacaacttcctgagcgtcctgtttcagtgcatgcatatcctttcagttgcctggggctgaaggcccagcctgaggcacccagacctcaggatcagtagcccgctggtctccatacaggcatttcttctacaaaaatgcccagggaccatttttatgggtcacatgagggggctggacaaattgtggttgtttttgtcagtaagccagggaatcataaatcttagttctgacactgtgctgctgaagtattagctgacgtgtgggcagtgacagtggcagcagtggggtgctagtactggctttgtcagcaggcactggggttggaaggcagctgctgcttggagaaaccgggcagccttgagagtaccctctctgtgcatgaaacgtgttcccggggatatacctttgctgggattaggtacagatgagaagacttcttgggttggaacttctgtctgtgttagtgtttgggttattgtctctaatagtaacttcagtgttcctcaagttgccagagaacacagtagctttaagaatatatatgcggg

SEQ ID NO: 15595 - DNA, 384 bp, Homo sapiens
tatgttatccccaacacctgaaaacaggatgaaagcgctgtttactgcaattccttttacccagtgtatcatgtctacctatcaacagaaaattacaaagcatacttaaaaggcagaaaatgcaggtgatgttatccccaacacctgaaaacaggatgaaagccctgtttactgcaattccttttacccagtgtatcatgtctacctatcaacagaaaattacaaagcatacttaaaaggcagaaaatgcagtttgaagagactgaacaagcattagaaccagagtcagtcgtggcaggagtgttgggcgataacgtatttatccccaacacagaaaagataatattgctaataaaatttaaaaagtgttgggcgataacatca

SEQ ID NO: 15596 - DNA, 432 bp, Homo sapiens
  misc_feature (5)..(5): n is a, c, g, or t
  misc_feature (107)..(107): n is a, c, g, or t
tggantgaggcccactgtccccccagcccaataacccccccttttaaaaaaggttatttatttaatatttttaagagatgggggtcctcacctcctattgcctcagncctagagtgcagtagccttgatcatgacctcatggcagccttgagcccccaggagttcaaggccagcctaggcagcatagcgagatcatctttcttaaaaaaaaaaaaaaaagaaaaaaaagaaaagaaaaagaaattttaagaattttttaaatactagagaccaaaaacaccataaccgaaaggaacagtgcctttgacaggctcgttagtggatggtacacggcctccaagagattgttatttgaaagtggacttgtattagctgtaaatgcagattgcaaaccaatttaaaaagttaaaaaagaagtatagttgatatgct

SEQ ID NO: 15597 - DNA, 584 bp, Homo sapiens
ctctattaggtactgacagtgaatatcagagaaaaatctccttgtgcttctggcaggaggaagtgaaaagggaccactttggaatataccattctgttcttaacaagacctgccctcaggagaaacaattttaccagggcctaacctgctggtgtttttatcagaacttaaccttcctgggggaagggaaatacctaacactagctacttctggatattctgtcccacctaatggcaggtgggggaagctgaaaagcacttgggaagttcatagtccagggacacaagctcagcaagactgagccctgctcatagtatcatagaacactttcccaccccaacacctgaaaacaggatgaaagccctgtttactgcaattccttttacccagtgtatcatgtctacctatcaacagaaaattacaaagcatacttaaaaggcagaaaatgcagtttgaagagactgaacaagcattagaaccagagtcagtcgtggcaggagtgttgggcgataacgtatttatccccaacacagaaaagataatattgctaataaaatttaaaaagtgttgggcgataacatca

SEQ ID NO: 15598 - DNA, 282 bp, Homo sapiens
aacaagcattagaaccagagtcagtcgtggcaggagtgttggagtaatcagaccaggtatttttttaaaactatgattaacgtgctgagggctttaagggaaaaagtagacagtatgcaaaaacagattgataatgtaagcaaaagagattaaaattttaagaagctggatgtggtggcacatacctgtatttgcaactcctcatagtgtagcaggattgcttgagcccaggagttcaaggccagcctaggcagcatagcgagatcatctttcttaaaaaaa

SEQ ID NO: 15599 - DNA, 441 bp, Homo sapiens
gacatcagaatacaactcaatgcacctcacgccattagacagcatgagtgacaagccgcagggaggatatatcagacagcaccagatcttagctggtaggaagctgattgacaagttctgtggaggacagagcagcagagccctgaagtccacagcaataaggggaagatggtgttctagacacaccagcagggaagagccaaacctggatggtcagtttgacctcccagggtaaggagcctctgggtcttctctacctctcccaggaccaccacagtgaaactagagccagagggttctttgctgaaaagagggtgagtgaggtggagagatgcagatgagaggaggctttatgcagaagccatcaggttgtgccatatctaaagcctggaaaaaggaggataccagctgataggatttggctctatgtccccaaccaaa

SEQ ID NO: 15600 - DNA, 947 bp, Homo sapiens
tataacaaagctaaacacaattaaatggtaaaagccactacaacttttaactcttgaaggactgaacagtaagatatcagaattttacatgcttttttagccacttctcccttgtctaggaaacccagtgcttttttctgacatagtggcatgcccaaacccagccataggttttcaggtttgacctctcaacaccactactttgttgcttttaaaataaatgtgctttcagagccttcagaaacatgtctacccattccagagagctatgacaatacagagaaagagagaaaaaagaaagagtcccaggagttgtgggcatatgccaggagaggccccacagagaagagacgtgccctcaagaaataatgccaacattaatccaagtctctgaagtggattgagccccaccagtaacaacaaagaggagcccagcacccttcccacagtgctctgtcacacagatatttatgaaggggttgcctcagaagcccacattcatccaagaggtggtgtcagtggtggaattagtcacacctgccagtgaatagcatataacagctgtacagacacaagtgagttattggtcttgggctacaatctcccaggaagcaaactatgcaatttctgctgcttccaggccaattgaaaggaacttaaacttgcaaatgattaagtgtcttaattgtgtcatcttaaagctttaagaataccaaaaggctgggagaaacccagctggggcattcagatgcctgaccctaaattttagcagccatgacacctttcatcctacttctccctcctcttcagatcctatacacaggttcttacttgcccaaagcaagctagttagtagaagaggcagccctagaaaccaaggcttctgactcctagtccagcattccttcttaccacagtgttctcttgtttttatataacaggaaagg

SEQ ID NO: 15601 - DNA, 2603 bp, Homo sapiens
ccctccacttttggagcttatcaggtaaaaatctcaagccacatgaattgttaacacctctgttgggaaaagcctttgtgagtttttatgtacttggtctttgtttttgttattcatcctgtgtcctccctcttcccgatgtgctgttttacctaggagttagtctgctttctgaggatcttttagagagaggctgtgaagtgctgaatcacctttaatgatacagcacttctgccatctcagcatctacataggacttacatagacttcctgaatgtgtcttcttcagatactaaagtacagttggatcattttcttatctccttttcttaagcagtactttgcaggtactcccctttgaaagccagaagcataaaccattggggaatcttaacttgtagacatgcagtaaaagaaatgcatttatgtaagatctgtgagtacttaaaaagaaagccctcagtgtgtgtgaagtgaatgtgaaatgtgtgtgaaatacatagaattcccaaatagtttagcaaaggcagggcgcaatatcaagtaatttaaaaatggtccaaggaactgtaagaaggaggaactaattctagaataaatgttaaaatgccattcaagaacaaaaccacagatgccatacagacctcctgtgcttaagttatagaagaataaaaatctgaatgaatggaaggccttacgtgtatacagtttacaaattcctatttctaaaatttaagtcccttatttaacagaagtatgtattttaatgcttaactgtctcgggaaacctcatttgtgacatcatctaaggggatgggaagactagggagccagtgccacgttgaacagaacagtggtttagtgaatgtgtgaggaaagacatgggcaactgattattaatgtttttgtaattcagtttataacttggaaccaatgaaaagcaacaaaactaaactggtttgacagcctgccacttctggcatttcctgtaagtcactagcagtaggtgtgaggtgggcttgcccatgaccaggaggggtgtgtgtgtgtgtgtgcatgtgtgtatatgcgtgttggtctgcagtcacagcatacctttatgtgcatgtgtcctcgcagcttgggactcagcagtattctgggagggtggaggtgaactgtcccatgtattgtattatatattttggagatggggtcttgctctgttgcccaggctggagtgcagtggtgcgatctcagctcactgcaacttttgcctcctggttcaagcagttctcctgcctcagcctgccaaatagctgggattacaggtgtgtaccaccactcccagctaatttttgtatttttagtagagatggggttttaccatgttggccaggctggtctcgagctcctggcctcaggtgatccacctgctttggcctcccaaagtgctgagattacaggcgtgaactaccgcgcctggccccatgtattgtatttttttcaggttatattgaaatctactaccaggaatgtcggaatgggttttggtatgtataatggaaatagatagagtggttaagtctagaaacacatacattaattgtattgaaatgttatatcaatacatcatttatgatgtgtgtgtggtcccagacctcatggccaccagtttgtttaagcattgtgaatgctttttaatagcattcattagcattaatggaggaggacactgtgttttctcaattaatctcattgatttgtttggtataagtttgggtcagaaatgaaactgccaaaacatcgatcagtacaaggaagggacacagggcttaaaatgtccacagtcttggcagtggacttggcagttctcccagtaagcagaagtacttgagctttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattttggtattgttgcctgcattttagccacttctaactttttgtattatgaatttggagaggataacaagccaactttagaccctctgccagtggcgatggtgtttttcttccatgggtaagccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgcggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatacaactcagaaac

SEQ ID NO: 15602 - DNA, 199 bp, Homo sapiens
ctctgccttcctcctgcagaggacccccacttcagaaaccccagtgccaggggtttggactggaacggagaggtgcggcgccttgaactggttggccaagtctgcaggcctgtttctccttctcatttatcattaatcttggccacaaccctggacaccagagagctcaaaatgatcagctttttgagagacctgggat

SEQ ID NO: 15603 - DNA, 493 bp, Homo sapiens
ctgggccattgtgctgctgatgcttggtggatgctgttgagtgagtgacttcacctttctgtggcctcagtttcctcatgtggaaaatgggagacataatagtgtctatctcataggtaaattattcagaaaggcatccagcacagagtaagcacactcttaacagctctttcaccggtagttatttaaacatgtattgtgaaatacattcttgcaacttctttctcactacttattctagaaacagagactcggagatctgaaagtggaacagcatcaaacacacacatcacccagaaacctagaacgttagagcttgcaagaagctcaaagaagctcaggcctaatctgaaacctattaacagaacccagttccaatgtaacaaatgcttattgagcacctactatgtgcatgcccttcactggacgtttagaatccgagactgatctcggctcttgaacagttcagaacttaatggggtagacaaagacc

SEQ ID NO: 15604 - DNA, 408 bp, Homo sapiens
gcggctggcgctcttcttcgtcaagagctccatgcacctggcgcgctgccgctgggccagtgcgcccccgctctacacgctcatcgacgtgctcaagtacagctacgtgcggcttgtgtgcaaggacgtgcgtgcgcccagccggcccgccgtgggaaacagagactcggagatctgaaagtggaacagcatcaaacacacacatcacccagaaacctagaacgttagagcttgcaagaagctcaaagaagctcaggcctaatctgaaacctattaacagaacccagttccaatgtaacaaatgcttattgagcacctactatgtgcatgcccttcactggacgtttagaatccgagactgatctcggctcttgaacagttcagaacttaatggggtagacaaagacc

SEQ ID NO: 15605 - DNA, 411 bp, Homo sapiens
gacaggtaggcagagtaaactagttcacttcgggtctgtttgtggattggtgatactctgtgtgaagacctggagaggattgttcccagacctagcacggccctggacccagttcatcagcagatgtttcccaaggaaaacagacatcaccctctaccctggctgacctctgccttccttttcctcctttgtcctgagtgagtaactgcacttagagaaaagctgcaccccaccaccattaagtggctttcaccaaacacacacctttccaagacccaatacttggaaggagaggcggttttcccttgcaagatggcagcaggatacagactctgccctgcctgggggactctgagcaggaccccaaagagctctgaccgtctcatgcctacactttttgggtccaccgcc

SEQ ID NO: 15606 - DNA, 316 bp, Homo sapiens
tactgacattgaatttaagttttgcctatatatgtgtatatgtttgtatatttgtatatttgtcacataaattcctagaaatggaattgatgagtcagagggtgtatgcatttgtaattttgactgatattgccgtctttatagagacactcctgctcataatatgaggatgcctatttccccatacctatgctagcctaagtttcaacagaccttgatcatttccaatcagatgggccagtttccacctgtcttctttttacagggctcagtcacaagtattttacaaaggattttctgtgttttcaagtggttt

SEQ ID NO: 15607 - DNA, 467 bp, Homo sapiens
tcagtggctctcagtgggcacaagaatagcagcaggaacaagattttgttatgtgtcttaggtcattttggagaatcagccttcctttctgtggtgctagctggggttagtcctgacggatcctaaggactgggtgcctaggggccattcctccctggggtctcagtggtgacagggctttccttaccccaagccagacaccaacctacactttaaacatagctcttggaggcccagttcattattgcagtgttatgtcagttgcacatttaagacttaccggcttttagctactttagggaataatttattggccaaagaaagtaagtctggttataaaatggcactttccagggaggtaccgggccccaaggtggaggctgtcgaggggacccgtttccaaggtccttcttcctagagtatgtgctgagggctgacacacacgtgcagtgtgagtcactgctgag

SEQ ID NO: 15608 - DNA, 435 bp, Homo sapiens
gacctcctactccccttcaggagcctctgcctggtcatctcgtcctgcaaataaagtggccattctgtgggtctgctcagccttttttttagaggaagatggagatgtttcctcactcgtggactgcacctcaggaaagataaagccagtgaattgaggattgcggagtattgcacacattcaggtgtcctgcagtggacaccatgacactgactccagcatgcctagaaatcaccatgggggtttaagagagtggcaccccctcagctctgcccccagaatgactggatttttgaacagactcccaggaagttctgatgtatctggttgatggaccacactggtggaacactgtgggaaaggtggggtgtacccctttcccaagcattctctgtcatctgcttttagaaaaataaagtacatgtagaaacaaag

SEQ ID NO: 15609 - DNA, 193 bp, Homo sapiens
aggagtaagagcatgcttaccgttttgatgcttttagccactgctcattagatgactccagccccaacttacttcctaaaaaccacctcaagtccaacatggatgttttattattaacagcatctcaaaccaaatactgactactctgagccccaaaccagaacactgaagcttttttttttttttttttttg

SEQ ID NO: 15610 - DNA, 470 bp, Homo sapiens
ctgtggaacactaggcgcgtcctggtgccaggaaggagtcgggacttgtttcttctgtacccatacatcccctgtggcttccgcctcctcctgggctttacggggaggtccagagggaagaggctgccaatttaagaaggaagacaccgtccttgccctgagggagtctctccattccgagggactccccatcacccacatgatatagtccaaccccataacccttcataactctcatctctcctgacctgtctgacctcgttttctgatcctcctaagaaattaaattcattcattcattcattcattcactcagcacttactgagaatctgctgaggatttagcagtaaacaaggatgacaagcatccagccgttttgcttgggttttgtttgtatgttttggttttcgttttgagacggagtctcgctctgttgcccaggctggagtgcagtggctcaatctcagct

SEQ ID NO: 15611 - DNA, 179 bp, Homo sapiens
tcaaggtctaagtgttcttcagtcagcttgtgtgaatgctgcttccaggcctgagaattacctttcagggaaatgggcttccctctggcccagagcaggtcccaaactgccatccaagagcccaggcttggatttatggaccccaagaccccacttggtgttctatcctatggtggctg

SEQ ID NO: 15612 - DNA, 942 bp, Homo sapiens
cacacgctcgcgctcgcggtccgcgggtcgccggggccgaaggcggcagagtcagagcgggagccgaagtcggagcaggagccatgggcggcgaaaccgacggcgccgggaggacgagggacggcgcagacggaggcggcggagccgggagcgcaggtcagattcagaggaagagcggtggcagcgctcagggatgcgaagccggagccccccgcggcccaagtggcactcaagagatgggtcctctcagtcggactcaggagaggagcagtcacggggccagtgggctcgccggcgacggcgcgcacgctcgtggtctcctagctcctcagcatccagctccgcgtctccagggcgatcccagagcccccgggcggccgcggctgccctgagccagcagcagagcctgcaggagcggctgcggctgcgggaggagcggaagcagcaggaggagctgatgaaggccttcgagacgcccgaggagaagcgcgcacggcggctggccaagaaggaggccaaggagcgcaagaagcgggagaagatgggctggggtgaggagtacatgggctacaccaacaccgacaaccccttcggagacaacaacctgctgggcaccttcatctggaataaggccctggagaagaaggggatcagccacctggaggagaaggagctgaaggagcggaacaagaggatccaggaggacaaccggctggagctgcagaaggtgaagcagctgcggctggagcgggagcgggagaaggccatgcgcgagcaggagctggagatgctgcagcgcgagaaggaggcagagcacttcaagacatgggaggagcaggaggacaacttccacctccagcaggccaagctgcgttccaagatccgcatccgggacgggcgggccaagcccatcgacctgctggccaagtacatcagcgctga

SEQ ID NO: 15613 - DNA, 168 bp, Homo sapiens
tcacttgattatttggttcagtgagaagtttatgaactggaacttaatgtgcaggcaactgcagggagcttgactacttgatagacatttgggggaaacttagtgattctcattgtaatacagtaaaatgcttgctagtaattgctacctttaggaagtaaaaagctt

SEQ ID NO: 15614 - DNA, 374 bp, Homo sapiens
tgtgtgcttcccctttaccctgttctcacttgggtccaaaccccacgcagcctgtgccaatcagaagccaagcctgggctccaggtcacagtgagacggagcccacataagggttcaggaggcagtcactgatgtggctgtgggggtcctcgggtgagcaggaccccgccccagcctcccaacctggggaggtcagagctcctgtctggttgaggcaagggctgtggatgcggggtgtggccagcagtgcagtgatgctaatgaagggattttctaatgagttttgtatagattttcatttttaatgaaggcagggaaaggataggctttattctgcaagcaatcaaataataaatctattctgctaagagatc

SEQ ID NO: 15615 - DNA, 461 bp, Homo sapiens
  misc_feature (121)..(121): n is a, c, g, or t
gggaactatcctcttgctttgttttacaagtgaggaaactgaggcgcagagtggtccaccatccatttagccctcagaatccctagagttaagtggttgctgaagcccaggatgagaactncaggcctcctggcccactgttcactgacctgctgttgagggcctcaagcactgaatggggctttcctggccccatattcttgtgtttccaaaacaaacctcccatgcaatgatgtttagataaatctcaactctaatcagtaaaaaacaagcaaaggacaagtatatttgcatctatagctatttaggtaaactgaagttaaataaaaattcaattccttagttgcattagccacatgtatctagtggccaccatattggactgtgcaaatacagaacatttccttcatggcaccgggttgggtagcactgacgtggattatcccaaggatcaaaaaaaa

SEQ ID NO: 15616 - DNA, 393 bp, Homo sapiens
caccactgtaggccccaggggatgcaagtcagggcctgcaaaagtgccttttccctcaccctctcccagtccgcacacaagagcagccacccctggtcttgccctcatgctggcccagccacacccaatggcaagggttctattgttaactcagattttttaaaaggacaaagaggagacatgttaggggcaggatgcacatttgtcattttaaaatatctccttaaattcttttcaatgaaacacaaatttgaattactgaaaagccatctatccaagtttttttttttttttagacagggtctcactctgtcacccataccagagtgcagtgagccgagatttgccactgcactccagcctgggcaacggaatgagactgtccccccacca

SEQ ID NO: 15617 - DNA, 155 bp, Homo sapiens
aagggagcagacagaaaccaatgtcaattatactcaatggtgagttgcagtgagggaggatcagttctccaaagggagtgaggacagagaactaaaagaagggagcagacagaaaccaatgtcaattatactcaatggtgagatactcttttatt

SEQ ID NO: 15618 - DNA, 328 bp, Homo sapiens
ataggcaacacacgtcactgctctcacagttcaatttataaccctccactgacacacctaccccactttattttacttttttattaaatgtctatctcctgaattagggaattcattgaggagagaagcaatatactaatcacctttaaatcagaactgcctcacacatagtaggcactcaataaaaatgccctagaaaaagcagagagttcaacaataatatgagagagcaagactgccaactattgattacagttatagagtttcataacttgagagcaaagtctataaaatatttctgtttccagtataatatatagcacattat

SEQ ID NO: 15619 - DNA, 300 bp, Homo sapiens
tattgacttgttttctgtcccagacagaatatggtgataaatgtcttacctgtatgtgagtagaatacgtattgtgctcttgttggcaggagtgttccataaatgtcaattacgtcaaattcattgatagtattattagagtttctgactaattttatcagttattgagagaggggatccagctattgtggatttgtccatttcttttttatttctgtcagttttgctttacgtattttgaagctctgtcattaggtatataaacatttagaatcattgtgtaccccttgttgaaatgat

SEQ ID NO: 15620 - DNA, 250 bp, Homo sapiens
aaggtgtgtaagtgatatcaggtaactattggattctgaaaggccccctggaaataaattatattcataaactctatagaaaccacacataaagggagcaactcgaagagggtagaagagggcttttatattaatcaggaaggaatgttgatatgtaatggtccagaaataactgaatggagcacctttatcctgacctagattgtagatttgagaacatttagtttacagatcatatgctggtgagcaa

SEQ ID NO: 15621 - DNA, 509 bp, Homo sapiens
agtttgggtgggagagaacaaaccgacaagttggttccagatgaggtggctgggagccaaccctcaggtacttggctctgagtaatgtgacggccccggcaagagggctcccactgcccaatgaggaacaaaagcctcaaggtctagtagtgtattcagcacatgcctaggaaacaagagttgggaccgtggacaaggagaggagcaaaggccaggggttaactgcttttggtttttcctctataaaagtcagggactatgatttatatgggtgagaaggtttggagtaggactgaagctgccatttacaaaccccttgccctaatttattgtagttttgggtgtgtttctgaaagaaccttttgcaggtgatttttattcagtactcattaacttacagcttttatgaattcacatcttctacactattgaaaaacatacttttgtattgtgttaagtgcagcatgagttattatatgaataaatcacattaaatttgcaaaaaaaaa

SEQ ID NO: 15622 - DNA, 354 bp, Homo sapiens
agaaagtgaggccaagaaacattaggtaactcatagcaggttacagagaaagctaagtggcagaaccggcattcgactctgctccagcaagcatgctcttttcttctacttcttttttctttatcccgtttttcaaatttccaacatggtgaaaccccatctctactaaaaaaaaaaaaaaaaaaaaaaaaaaaaaaaaaaaaaaaaatagccaggtgtggtggtgcatgcctgtaaccctagctgcttgggaggctgagttgggaggatcccttgaacctgggaggcagagattgcagtaagctgagatcatgacactgcactatagcctgggtgacaaggcaagacaatgtc

SEQ ID NO: 15623 - DNA, 565 bp, Homo sapiens
tcccgagtagctgggactacaggcgcccgccaccacgcctggctaatttttgtacttttagtagagacggggtttcaccctgttagccaggatggtctcgatctcctgacctcgtgttccgcccgcctgggcctcccagagtgctgggattacaggcgtgagccaccgcaccctgccttaaaccttaactttttaaaccttattttaaaagcagtattttctaagtccctctcactaaaacaatcctctcaaccaagccttctcttttcagataaattcatagaaactttaggtttaagatactttgttggccaggtgtggtggcttacaccaggaatcccagcactttgggaggccaaggctggtagatcacttgagtccaggagttccagaccagccagggcaacatggcgaaaccccatctcaacaaaaagtacaaatattagctgggcttgatggcatgcatctgtggtcccagctactcaggcggctaaggtgggaggttcacttgagctcaggaggcagaggttgcagtgagccaagatcacaccattccactccagcc

SEQ ID NO: 15624 - DNA, 2497 bp, Homo sapiens
gaaaattacacaatggcattcacgatcctagtcttatatcagtatataaattggtttattatttcattctattaaagaggcttttttttggtaccaggaaaacttcaaaatgcattgtgttgtcagcctcactgaattttcttttggaggaggaggtagggaggggaagccaaagccccgatttctcctgctccttttgctaattgtattggctaaatgagctttcacagaggggggtcctggctgctttttgctctcccccagaccacttgtaggttgcacacagggcttctataactctttctgagtcaggacaaagatatccgccgtgcacaccctgtgacataggtggatatttatttcatcccgggcaattctaaattttgtcatgatgactgaaagaggcaatcccctcctgagcattaagaggccaggggtgagagggtggcagcatagaaaagccaccacccagagacagcttggagccatgatcctggaggaaatgttattaataaacatcttttggacatttggtagcccgtggagcttgctccagcttaaagcaattaattcaggacactgacataaactctccagatctttgacagcttggagccgaaataaaaatgctagttctccggggaagagaagaggatggctagcccttttctggactgtttgcttataggcccagagagcaaccttccttgcagaatgaaatgcaagggcacaaacaatgtaccagggagagaatagaagatgggaatgaacagtttgaactatttgctcagcagaagggcaccacaatgctggggtagtggttttcccatgcgtccactgtcccttctttgggatcttttgttgtcccctgtctcctttggccagataaaagcacagctgcagcattgcagataacaagtaggccgtacttatccccctaaatctcggggtgcctttactgtaacaagttatgctcggctctcttttattttacaagaggatggtgagggagagaatggaagaacagagggggcggacgtataagacatttgacactgcctatgtctgatttctctttctttctttctttctttctttctttctttctttctttctttcctttctttctttcttgcaagctgtgatcggatgcaatctttgtgggacatttaaatggaagggttcattgatgtgtattgcttgccaagccaaaatgttgcctttggggaaaagggagagaggtgttcatggagtgcagggaaaggaggttttggggcagagattttgacttaaaataaccagacttcttctggctgctgaaaagaggcaaaagttttaaattgtcaagtttaaaactatgttcagttatgatttgccacttctgaatattattttggatttcccctttcatgcttattttgttcagaatcctaatgaatagaggttgctggactcagggtaaaagcaggatgaactggagatgggacatacaaggtacttttggaattgccatagattacacctataatcagagtaaatgtcatcaacaaataatcaaaatattttttacatttgctcttctaaaatcagagcctattttaaatataaaagaaagtagatgtgataataatataaactacagtcacattaagttgatattaaattcaaaatctaacatagatttgcactgttgggtgtgtgttccgaatcagtgggttttcccactgatgttgatttcgggagccaggcttcaatgtttaattctattgtaatgtggttatttagcctgaatggttttataaggtggaaaggcaaaaaatttaattccgaagaaaactagtgttttactatgactgtggtaaacatttccaaagcccacctgtgggaaatacaaagttttaatgctgtgtgtttttttgtttttgtattttgtctcatcgacaaaactggcagaaaaaaacgctttcgtatatttttcctgctgggtggtcagaaggaaaggccgtgaagctaaaggtctcccactgagacgctgttctgcaaggagccgacctcacgtgccgccgccgccagagaagagagcacctgttcatctcggctcactgtgaggctgagctcagcgctggcaggcgaggggccgcaagcatcccccacagccaccgagagggcatccctgcagggaaatcatatccgacatgcctgtgcccacagcagacttaagactgcctctaaaatgtccatgaagccattgtccagtagagctgttagttttaacaccagtgagtattacctttggttaaaaggatgcatgtgtataggtgtatgtgtgtgcgtgtgtgtttgtgtttttggacttgtgtggagaatgaagaaagggttccatttaggcatttgcaaatattcgatggcatcatgaaaagacaaaaaaatcctataaaatatatcatattttgctatgattttgtgtgtacatgtaataaaattattaagtataaat

SEQ ID NO: 15625 - DNA, 2439 bp, Homo sapiens
gaaaattacacaatggcattcacgatcctagtcttatatcagtatataaattggtttattatttcattctattaaagaggcttttttttggtaccaggaaaacttcaaaatgcattgtgttgtcagcctcactgaattttcttttggaggaggaggtagggaggggaagccaaagccccgatttctcctgctccttttgctaattgtattggctaaatgagctttcacagaggggggtcctggctgctttttgctctcccccagaccacttgtaggttgcacacagggcttctataactctttctgagtcaggacaaagatatccgccgtgcacaccctgtgacataggtggatatttatttcatcccgggcaattctaaattttgtcatgatgactgaaagaggcaatcccctcctgagcattaagaggccaggggtgagagggtggcagcatagaaaagccaccacccagagacagcttggagccatgatcctggaggaaatgttattaataaacatcttttggacatttggtagcccgtggagcttgctccagcttaaagcaattaattcaggacactgacataaactctccagatctttgacagcttggagccgaaataaaaatgctagttctccggggaagagaagaggatggctagcccttttctggactgtttgcttataggcccagagagcaaccttccttgcagaatgaaatgcaagggcacaaacaatgtaccagggagagaatagaagatgggaatgaacagtttgaactatttgctcagcagaagggcaccacaatgctggggtagtggttttcccatgcgtccactgtcccttctttgggatcttttgttgtcccctgtctcctttggccagataaaagcacagctgcagcattgcagataacaagtaggccgtacttatccccctaaatctcggggtgcctttactgtaacaagttatgctcggctctcttttattttacaagaggatggtgagggagagaatggaagaacagagggggcggacgtataagacatttgacactgcctatgtctgatttctctttctttctttctttctttctttctttctttctttctttctttcctttctttctttcttgcaagctgtgatcggatgcaatctttgtgggacatttaaatggaagggttcattgatgtgtattgcttgccaagccaaaatgttgcctttggggaaaagggagagaggtgttcatggagtgcagggaaaggaggttttggggcagagattttgacttaaaataaccagacttcttctggctgctgaaaagaggcaaaagttttaaattgtcaagtttaaaactatgttcagttatgatttgccacttctgaatattattttggatttcccctttcatgcttattttgttcagaatcctaatgaatagaggttgctggactcagggtaaaagcaggatgaactggagatgggacatacaaggtacttttggaattgccatagattacacctataatcagagtaaatgtcatcaacaaataatcaaaatattttttacatttgctcttctaaaatcagagcctattttaaatataaaagaaagtagatgtgataataatataaactacagtcacattaagttgatattaaattcaaaatctaacatagatttgcactgttgggtgtgtgttccgaatcagtgggttttcccactgatgttgatttcgggagccaggcttcaatgtttaattctattgtaatgtggttatttagcctgaatggttttataaggtggaaaggcaaaaaatttaattccgaagaaaactagtgttttactatgactgtggtaaacatttccaaagcccacctgtgggaaatacaaagttttaatgctgtgtgtttttttgtttttgtattttgtctcatcgacaaaactggcagaaaaagtctcccactgagacgctgttctgcaaggagccgacctcacgtgccgccgccgccagagaagagagcacctgttcatctcggctcactgtgaggctgagctcagcgctggcaggcgaggggccgcaagcatcccccacagccaccgagagggcatccctgcagggaaatcatatccgacatgcctgtgcccacagcagacttaagactgcctctaaaatgtccatgaagccattgtccagtagagctgttagttttaacaccagtgagtattacctttggttaaaaggatgcatgtgtataggtgtatgtgtgtgcgtgtgtgtttgtgtttttggacttgtgtggagaatgaagaaagggttccatttaggcatttgcaaatattcgatggcatcatgaaaagacaaaaaaatcctataaaatatatcatattttgctatgattttgtgtgtacatgtaataaaattattaagtataaat

SEQ ID NO: 15626 - DNA, 2861 bp, Homo sapiens
gaaaattacacaatggcattcacgatcctagtcttatatcagtatataaattggtttattatttcattctattaaagaggcttttttttggtaccaggaaaacttcaaaatgcattgtgttgtcagcctcactgaattttcttttggaggaggaggtagggaggggaagccaaagccccgatttctcctgctccttttgctaattgtattggctaaatgagctttcacagaggggggtcctggctgctttttgctctcccccagaccacttgtaggttgcacacagggcttctataactctttctgagtcaggacaaagatatccgccgtgcacaccctgtgacataggtggatatttatttcatcccgggcaattctaaattttgtcatgatgactgaaagaggcaatcccctcctgagcattaagaggccaggggtgagagggtggcagcatagaaaagccaccacccagagacagcttggagccatgatcctggaggaaatgttattaataaacatcttttggacatttggtagcccgtggagcttgctccagcttaaagcaattaattcaggacactgacataaactctccagatctttgacagcttggagccgaaataaaaatgctagttctccggggaagagaagaggatggctagcccttttctggactgtttgcttataggcccagagagcaaccttccttgcagaatgaaatgcaagggcacaaacaatgtaccagggagagaatagaagatgggaatgaacagtttgaactatttgctcagcagaagggcaccacaatgctggggtagtggttttcccatgcgtccactgtcccttctttgggatcttttgttgtcccctgtctcctttggccagataaaagcacagctgcagcattgcagataacaagtaggccgtacttatccccctaaatctcggggtgcctttactgtaacaagttatgctcggctctcttttattttacaagaggatggtgagggagagaatggaagaacagagggggcggacgtataagacatttgacactgcctatgtctgatttctctttctttctttctttctttctttctttctttctttctttctttcctttctttctttcttgcaagctgtgatcggatgcaatctttgtgggacatttaaatggaagggttcattgatgtgtattgcttgccaagccaaaatgttgcctttggggaaaagggagagaggtgttcatggagtgcagggaaaggaggttttggggcagagattttgacttaaaataaccagacttcttctggctgctgaaaagaggcaaaagttttaaattgtcaagtttaaaactatgttcagttatgatttgccacttctgaatattattttggatttcccctttcatgcttattttgttcagaatcctaatgaatagaggttgctggactcagggtaaaagcaggatgaactggagatgggacatacaaggtacttttggaattgccatagattacacctataatcagagtaaatgtcatcaacaaataatcaaaatattttttacatttgctcttctaaaatcagagcctattttaaatataaaagaaagtagatgtgataataatataaactacagtcacattaagttgatattaaattcaaaatctaacatagatttgcactgttgggtgtgtgttccgaatcagtgggttttcccactgatgttgatttcgggagccaggcttcaatgtttaattctattgtaatgtggttatttagcctgaatggttttataaggtggaaaggcaaaaaatttaattccgaagaaaactagtgttttactatgactgtggtaaacatttccaaagcccacctgtgggaaatacaaagttttaatgctgtgtgtttttttgtttttgtattttgtctcatcgacaaaactggcagaaaaagtctcccactgagacgctgttctgcaaggagccgacctcacgtgccgccgccgccagagaagagagcacctgttcatctcggctcactgtgaggctgagctcagcgctggcaggcgaggggccgcaagcatcccccacagccaccgagagggcatccctgcagggaaatcatatccgacatgcctgtgcccacagcagacttaagactgcctctaaaatgtccatgaagccattgtccagtagagctgttagttttaacaccagttcataggtggaagggacttgccttgtctcagatgagactttggactgtggatttctaagttaatgctgaaatgagttaagacttttggggactgctgggaagtctcaggtatgtctttatcagcagcatgaaaacggactaatatagcacctctgctgacagctataggaccaaggactgtagacccaaatgcagcagccacacgtattttcctgtcatgaagattttctttaataaagctgcaagttttggggaaagtatgtgtgatgactgggaactgattcccgaaggctagctgcaaaccacgactgggaaagaagcaggatgggcccagactttgcggtggctgctgtccaccagaacattcaggttcagaagggtcgtgggggtccccgagcctgctgaaagatgaggcccagtcctggctccactcaacttaccgcacccatgcttcattgctcctcaaagcactcacgactctgatattttgcttctatatttgcttcttatttgtctcccatcactaggatgaaatcttccagagagcaatggttttctctgtcttattcactgttgtaaatagtgcctggcacatagtaggcactgaataaatatttgttgaatcaatgcatgaatga

SEQ ID NO: 15627 - DNA, 433 bp, Homo sapiens
gtccagagtgtatagttatatattaatctaaactgaataaaattagatttttcacatttgattttgaggatttgagtattaatgtttaatatttaattagatggctcaatttcaaatgctaatataatcaggcctagatgtccaatttttgcaaaattcctgtactactcttaaacataagtgtactctgataaagataagcaatctgttcccacacctggaataagccttgtctataaacaatggaaattttgaaggacttagtgtttccttgggagaggaggtaatgagtaatcacaaagactaggactagctgatttcataacactttttacaaaaacagtttaaagtaataagtggaaattttgttcacttacgatgccaatacaaatcttatgccaagttccatcacaaaaattttttgaaaaatact

SEQ ID NO: 15628 - DNA, 754 bp, Homo sapiens
aagcggaggttgcggtaagctgagatcgtgccattgcactccagcctaggcaacaagagtgaaactgcatcttaaaaataaagaaggtatgggtttcctggaactttgggggatcattataaaaatactagggtaaaaaagcaaccttagtaatcccagcaatttgggaggccgaggcgggtggatcatgaggtcaggaatttgagaccagcctgaccaacatggtgaaaccctgtctctactaatacaaaaattagacaggcgtggtggcgggcacctgtaatcccagctactcaggaggctgaggcaggagaatcgcttgaaatcggaaggtggaggttgcagtgagctgagattgccccactgcactcccgcctggtcaacaagagtgaaactctgtctcaaaaaaaaaaaagcaaccttaggatgaaagaaacattcaacataagccctatattccatcatctctgttacctcagcataccttgacttaactataatttcctattctagaaatgtcctccccctcttgccagtgacatgtttctgtactgtcagattcagttctagtgccatctctttgtgaagtcactgagagtcccaactgggtgagagggctgtgccttcaaactctccctccttcagagcatgtaatgatagtacaaactaactgacaaaaactacatccaacaccaagttcatgttttatacagcaggagcattacttctctctgatttgaaaatctgtggggga

SEQ ID NO: 15629 - DNA, 461 bp, Homo sapiens
cagctcttttcctggttgtccttgaagctgtggtgaagaaccttagagacaactgtctagggttttcctccttgttaaaaaacttctctcttaccactcttgctcttgatttttaaggagacaaaatctaactgacacaagtccctctccggctgattatgtcgcttcaaacattgtgcaaggcattattggtagttcaacttgtcattcgggctcaggaatcgaactgatctacgtggagtgaggacagttaagtctgcagtggaaacaaggctgtagggcttccccctgagagcagcagccaaggaatgctgctgtcatgctgtcacaaactctgcccctgactctatcaaaacaatgatttccaattatttcatctctttggtcctagatttcttctatctataaactaaccactttcctgccacaagagactgtcatgaagaggaattaaatttaaa

SEQ ID NO: 15630 - DNA, 165 bp, Homo sapiens
tgatcataatgtaggtggttgggttgaaggtatgtgtgagatgccatctctgtttggaaagagcactgcattagaaacggcgatctagcttctaacattttcttacttgcctctgggctaaaaggtttgattagaaaaggctcaccaatatttaaatgactaaca

SEQ ID NO: 15631 - DNA, 433 bp, Homo sapiens
cttaatgatgggaaagcatagggtagcttaagaaaaaataagctattaatatatatataggagaacagacaaaaataaagttggtgaggtaggttaaggctgaatgtcaaactgaagaatcagtacttattcaggtaaggaagattttcaatccaaggagtgacaagaaaatcaagctgaccactgtgagtcaaatggatttggatagggaaggagtaaataccaaaattctatcacagtagttcagatagaaagatatagaaacctaaactagggaagcagtgaaagtagagaacatgttcctacctacaggatggacttgctttttgtatgatctaaaggagaaaacatggctaatcattaagagtccaagactgggtagttgagaaaatagtgatgccattaatttaaatgcagagataggggagagaat

SEQ ID NO: 15632 - DNA, 525 bp, Homo sapiens
cttttaagatgacgttttttcgagtccaaattagattgctcatctgaagatgagtgcgccacagcagtgttcccttgttatgttgcttggttattgttccacatttcctcattcattccgccactgtttcatgcagcagcagaaatcaatgtgcctatgacatgaaggcacagcaagggttggccaacagcattctctttgttgtttctccaaacaccacacgtgctcagtagccgtaagatttttttcaagttttactaaggaagtgatattcaggaattttaacagaaaacagtaagtcctgtgagttggagttctagctgcaaacccaagaaggaaagcctttaagtgtggccaccagcaggggtctgataagatgtgtatggcttagggtgaccactcattggaatgcagtgtacccattgaagaggactgggcagctctggatttgttgataccagtcaccatgacagatgaagtgaaaaagcaggttgcagaccatgtgtagaacatggtaactatgtt

SEQ ID NO: 15633 - DNA, 853 bp, Homo sapiens
tgagctacgagataagaatgaagttaccagaagttatcaggtcatagtttcagagtatgcaagagagtcgggccttcatatgttcttgtaaagttttctgtctaatcttttggtataacaattttaggagttcaccctagatgaaagagtggaagtcatcagatttgtcaataagcagtctagaggaaaaatgagaagaggaagaagcagggattctttttcttgtgttttgaagatgtttctcctcccaaagctatcaccttggtagttatcaccaagatgtataatagcaagcactactgaatgatcttcccagttatcagcactagcatcacggcgagtcagttttcagaactagctcttggcgcaagccctgaaataaaatggggacaaaaagtggtctaccaccatgtgacttattttctttttttttttaattttattattattatactttaagttttagggtacatgtgcacaacgtgcaggtttgttacatatgtatacatgtgccatgttggtgtgctgtacctattaactcgtcatttagcatcaggtatatctcctaatgctatccctcccccctccccccaccccacaacactccccggtgtgtgatgttccccttcctgtgcacgtgacttattttcaattgcccagcaatgaaaactaacaagttaaagaaaatgttcattttctgaaccccagagcccacataggtacaaagatactctgtaatgtacaatgaggtggccaatcgtgggaatataggagcaataaatagtcctcttaagcaaggttcatgggtaagagttactctagcaggattgggtgttgggtcagagggtatcta

SEQ ID NO: 15634 - DNA, 432 bp, Homo sapiens
gctgtacgttatcagtagttgagccttcccggcctgtttcataaggaactggcttctgtgacccaagtctgatgagcctgagacaagcttggctttacagcatcgagctgcaaaaggcaggtcgaagtcactgtgtggaaaccctgggctcctgcagacctatggttgtgcttatttccgaatgccttagccccttggcagggctgagaaagcgagagctcagtaggtcacatgaccacttgtgagccaatcactgttgcactgggatggcacacactgattggccagccctgggcagcgctcccaccctgcaggtgtttgaagtctgtgtatgagggatgtggtctggctatgggaaagcagggagctgtttcaataccaagggggcaggatttcaaagaagaaaaataaatcatttcaattacctagaaa

SEQ ID NO: 15635 - DNA, 471 bp, Homo sapiens
tggggctccagtgtagattggagcagtgaagttagatgagatttgtagcacctcctgatgaccatgctaatcactcctctaccacagttacctctcccattattagtaacttgttagctcatcacatttcttcagcaccactttatcctctttaaccatctgtcctatttatatactcagaatacctggcacctaccaaatgagagtaagcaccatagtaaccggggatgaaattattgtatatgtactttgtgctgtcagcaacatgtatcctgagatctttgttgaagagtcagttaatgaaatttgagagtccttggattatctgacatgtaaagttgtgagccagatgtggtggcatgcacctgtagtcccagcactttgggaggcccagcggggaggatcccttgagcccaggagttcaaaaccagccgaggcaacaaagtgagacactgtctctaaaaataatac

SEQ ID NO: 15636 - DNA, 283 bp, Homo sapiens
tgatcttaggctggcatcccccaggtgtatctgtgcaactcaccatttcgctggattgctgcatgcacacaacactcttaggaaggcacaaaaaatagatcttgtggtttcagccttctatgatgatgctgagttccctcaaagattaggtctgggccaggtgcagtggctctcgcctataatcccagcactttaggaggccgaggtgggcagatcacccgaggtcaggagtttgagaccagcctggccaacatggtgaaaccccatctctactaaaaatcca

SEQ ID NO: 15637 - DNA, 447 bp, Homo sapiens
ccccatttaagagagcatctgctgctatgataacatagttcacattttatgacactttgaaaattgcctgctttttccttctatataactgcatatcctagagagcaaatatcacacattcattggtggatcttcaacgtttgaccgtcgagtatccactaggtgcttactaagagctgtgtagtgcttaagagtgagactgtggagtcagactgtgttggtttaaatacaggtatcgcttcctactgaccatgtgattatagccaaaatatttaatctgcctgtgtctcagtctcccatttgataaaataagaataattatgtatctgcatcacagggttgttataaaaatgaaattaatacatacacatacagtgattagaacaggatatggtctatgatgagcactcaataaatactagtttttaaaacgatgctgtaaaattg

SEQ ID NO: 15638 - DNA, 181 bp, Homo sapiens
aattggaaaaaagtgaaaatgctgcaatagttataaattggtgcaaattttccaggaatttgctctaaggctaatatttgaagagctgaaaacgtgtttaaatggtattttctaagatgtaactctagaacacccaacaagtaaatttgactccgttcccaaaaatttggtgctaatatta

SEQ ID NO: 15639 - DNA, 327 bp, Homo sapiens
acagagaagagcaatgcaattaatggaaactgagagggtttgaaggagttgtccttagtgtcaattgtgcaaacatgtatattaagatctacagaatgttttgtattgtattcggcataaagacatactcattgacctcagacttgtacagtttcagtagaacattattggaagagctgagtttgagacctaatattttccaggttataagggtaacagctaagttaggaattaaaaatgaaatggcactttgggaggctgaggcgggcggatcactttaggccaggtgttcaagtccaacctggccaacatggtgaaaacctgtgt

SEQ ID NO: 15640 - DNA, 332 bp, Homo sapiens
tgagacagagtctccctctgttgcccaggctggagtgcagtggcgtgatcttggctcactgcaacctccgccgcctgtgttcaagtgattctcctgcctcagcctcctgagtagctgggattacaagtgtgtgccaccactcagctaattttcgtatttttagtagaaacggggtttcaccatgttggccaggctggtcttgaactcctgacctcaagtgatccgcatacctcccaaaatgctgggattacaggggtgaaccaccgcacctggccagaagtcgtatttcaaacatatagccattactaattataatactagatcagtacact

SEQ ID NO: 15641 - DNA, 426 bp, Homo sapiens
ctctgcattttctatgtgacccaaaactatataaaatgttaccaaatgacatttctgccattctgcttacttcatttacagaattcaaacaagtataatgagcaaggtcttttcctccaaattttcttttttttttttgagacggagtttccctctgtcgcccaggctgcagtgcagtggcatgatctcgtctcaccacaacctccacctcctgggttaaagtgattctcctgcatcagcctcctgcgtagctgggattacaggtgcataccaccacacccagctaattttgtatttttagtagagatggggtttctccatgttggtcaggctggtctcgaactcctgacctcaggtgatccgcctgccttggcctcccaaagtgctgggattacaggcatgaaccaccacatctggccccaaatt

SEQ ID NO: 15642 - DNA, 393 bp, Homo sapiens
gactacatatggtgcaatatggctttaagttaaataaatgatattgtcttaaatgtacccccatacttaaaatagccatatgaaaaaatactgatctatattgtttctttttcatacacacacatacattacagaatttgtttgtaaaagcaaagcactaattacctaaccacctcaacacaatgactatttaaaaatatttatttatattagatctcaaaacaaatcttctattgttcatgtaagtaaattttcttgagtttttgtccgatttttataattctgaaaactagtaatacatttcacttttctgtacacagatatttttataaactgcaatatgtttgaaagtattttttccattaaataaaagagtagtattatgtttcgaag

SEQ ID NO: 15643 - DNA, 298 bp, Homo sapiens
gaattgtataactcatgcaaacagcctttaggtcaaacagggatttgaaattaaaactgcagaatatctagagaatagcaataatgcaatcattacttatcagagactaaaggagagctcagaggaatgttcattgccaaatccttgtgccattaagaaaagaatgaaaatgaatcaagcctctgattgttagaaaggacaataaaaaaaacctgaaggaggccagggacagtggcttactcctataatcctagcactttggtaggctgagatgagtggatggcctgagctcaggagt

SEQ ID NO: 15644 - DNA, 377 bp, Homo sapiens
tacacctaacacacatcaagaaaggcatacaggagttccacaaactcgcacacaacacagaacaaaagtggcagaaaaaccacaaaagagggctgtggctggaaagcacaaccaggagctgccccactgtccccatctgtccagaggcacctggagccaggtgtgtcccttaaaccttgtccacacaagatgctcccagcacgcagcacttgtttccctgtctacaccttcctgccacctgacaggcactgacaacaggccttctggttttgcagcagaaagcaagccccaggccaggtgcggtctcatgcctgtaatcccagtgctttgggaggcgaaggcacgaggatcacttgaggccaggagtttgaggctgc

SEQ ID NO: 15645 - DNA, 430 bp, Homo sapiens
ggcaattaatgaatgaatcctatccactaagtacatttgaaaaataaatggtcatccagtctaatacacaatcccttcttggagatgcttacaggccttggactctaggcctcatcttctagttagttgaaaaccggctccagaggttatcctgccttcttgggtggaagggtacagtgtttacatggcaggctgagtggacaggggcttagttcatctagcatatatgatctgtccaattacagaacaggtgctcttgggaagacaccatattcctttcttttgtggtgtccttccctgtacccaccacagtgctaagcatgtaacaaatggtcaataaagtccacgtcatctctggaattcgacagctatatttgcagtggttatttgctactacaacactaaaaaacaataaaacaaaacaaacccc

SEQ ID NO: 15646 - DNA, 151 bp, Homo sapiens
aagtgggattacataggaatttaactgaagtaaatgatcatcaatgtgtacaaagatctagctgcaagaatgttcttggcaaaattgtttatcacaggggaagggcacaaacaatttgagtgggtaaaagtaccacatatgttaatgatac

SEQ ID NO: 15647 - DNA, 223 bp, Homo sapiens
ctgtgctattgcacagttccacatgaatggatgcacttttttggcaaagtgatgagagaaatagcaaagaaaaaaataattggggttctccactcactgtctgcacaacagggaaccttttctgcagttttcttatcaaaagggtagccttattaagagttttaggtgcccacaccacagctaccaccaacctactgtggcagcatagttctacaactagacc

SEQ ID NO: 15648 - DNA, 198 bp, Homo sapiens
cttccctgaattattcttctctgtttagtttgcctggtaaaccccatttcttctgtttgtttaaactacagtttctcaacctcagtgttattgacatgtggggctggacaattctttgtggtgaggggcagctctgtcccttataggatgtttaacagtatccctggcctctgcccaccagatgccagtggcacccct

SEQ ID NO: 15649 - DNA, 419 bp, Homo sapiens
acaggattttccagtgtctagaaatgcactgcttgaagagcagcagaatatattacactggagaagagaagactgtaaggggctagatgcttcatctgcaagaagagtagacttgccctgaaggaataatcaggccagtgagaaagagcatatgcacatagatttgagctcagtaaagaataaacctgagcagtcccacaagggaacagtactccccagaggataagctgccaaatatgggcagtgttcaagcagaggtgcaaggaacacctgccaggtaaacaatggacacctgccctgaggaggccgtgagatagatcatctccaaagacaccatcaacctctatgaaaaggaaggatgggcttattatgaccactattcagagagaagaaactcttaatgttttcctgtgatatta

SEQ ID NO: 15650 - DNA, 315 bp, Homo sapiens
atcttttgagcccaggagtttgagaccagcatgggcaacactgtgagaccctgcctcaaataacaataatagtaataataaaattgtaaaaagaaaacaaacaaaaagaaactaacattcttcagataacaaacatatagcgatggaaagccaattagtagttgccaggggtcagcgacacagtcagggagcaaatacaaaggagtagggcacataggggagcaaagggatcctgatggtatgataccatccaaagttaatgtaacaagaaattgagatttaagaattctacttatgtgttaaacacaataaaat

SEQ ID NO: 15651 - DNA, 877 bp, Homo sapiens
aagcatttaatcaaattttgaggactaacaaacacaatttgggagtccaaccgcgagcggcggcggccagagggcggtggattggacgctccaccaatcacagggcagcgccggcttatataagcccggggcccgagcatagcagcaacgcaaaacctgctctttagatttcgagcttattctcttctagcagtttcttgccaccatgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaa

SEQ ID NO: 15652 - DNA, 599 bp, Homo sapiens
aagcatttaatcaaattttgaggactaacaaacacaatttgggagtccaaccgcgagcggcggcggccagagggcggtggattggacgctccaccaatcacagggcagcgccggcttatataagcccggggcccgagcatagcagcaacgcaaaacctgctctttagatttcgagcttattctcttctagcagtttcttgccaccatgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgatcagctctgagactgggggccccgtcgcattgtgcgctgtagtcaggcgccagtcgcactacgcacgccgcgttggcgacggcgcatcagatgcggcggcggacaaatacgcctgttgcc

SEQ ID NO: 15653 - DNA, 274 bp, Homo sapiens
tcacacctataatctcaacactttgggaggctgacatgtgaggactgcttgagtctaggagttcaggacaatcatgggcaacatagagagacctgttctctacaaaaattaaaaaaaaaaaaattagctgggtgtagcagtgcagagctgaaatcccagctacctaggaggctgaggtgagagggtcgcttgagcccaggagttcagagcttacggtgagccgccatcacgctattgcactccaacttgggtgacagaccgagatcctagctta

SEQ ID NO: 15654 - DNA, 409 bp, Homo sapiens
gaaatactgctcacttcttcatccagttgactgaatcagagcctgcctcagaataactgctcagaaataggaatttcttcttggtcaaccccaggctttgaagggcctttggtcattcttgcccttgtgctacagttctgctgcgataatctgaatttgccatgttcgtggtgctgggaaatcagatgaatgaaagctcttagaaacccatctcctgactctactttatgtatcaaggtttagaattatcagagcagaacctggtgtttgcccctgtggtcccagctccttgggaggctgaggtgggatgatcacttgagtccaggagtttgaggctgtaatgagctgtggttatttcacagtactccagcctggatgacagagtgagaccctatctccatctgttaaa

SEQ ID NO: 15655 - DNA, 334 bp, Homo sapiens
gcgccccggcctctccgtttcttaaaagtttaaaaaggtttatagattaaagtctataggttggttttattactaagaacttctaaaatgcaccagctgatttaaaaaaaaaagaaaagaaaactgtaataggctgaaggtgggaatgacttaaaacaggtaaaagagatcattttggtgtgacagaaatgttctaaaacgggattgaggtaatagttgcatggcactgtaattttactaaaaagcactgaattgtgcacttaaaaagaattaatatgactaacaaattcccccaaaaaacctattaatataataaatattgtgaccccccccc

SEQ ID NO: 15656 - DNA, 1030 bp, Homo sapiens
ttttagtagagacagggttttgtcatgttggccagtctgttctgaaactgctgacctcaagtgattcacctgcctcggcctcccaaagtgctgggattgcaggagggagccaccgcacctgaccccattttgttttgttgtgagagaccataaacagcctagaaagatagaaatctcaataatgagaagtttctgtaatgtgtggctcctgcccaccttctctctgcttatttgctgtcttttttgtttgtttgtttttttagagatagggccttctctgtcacccaggctggagtgcagtggtgacatcatggctcactgaagcctcaaactcctggagtcaagcaatgcttctacctccacctcccgagtagctgtgactacaggcaggtgccaccacagaaggacagaccatctaaggaaaacttaaaaagacagcacaaggacaggctggacagccaccagacctggctaattttttattttttgttttattttttgtagagaccagacctcactatgttgcccaggctggtctcgaacatctggccccaacaatcctctcacctcggcctcccaaagcactgggattataggcatgagccatcaccccaggcctatttgctgtcttgattctcttttctgctccctccagccccacagatggcccaagaccccaaatgggcagtcaagcttccccactaagttgagtttctttactggacaactcaagatgtcttggtgagatcctgtcttgaaacaatgccaggaaagtacatgaggtctccttcctcctaaaaacacccctagaaggaggcctgggaggggcaagcctggcggttcaaactggtgattcaaccacccacataagaccctctaggcctaatggctgggtgaggggctcagagaatttctccaatcttggccagaaaggcttccttaccactttcacatttctctcgtgtccttcagaaggggcctgcatccaaaagtggccatggaaagcttcacagaattagcttttattgta

SEQ ID NO: 15657 - DNA, 578 bp, Homo sapiens
actggattcacagaagaaaaaagagactaaaaaaaagaaatacttgagataatgacctagaattttccagaaaaaaaaaaaaaaaaattccaaaccacagatccaagaagtttagagaaatcctaagcaaggtaaatataaaacaaaccaacaaacacacaagcctggaaacatcaaaatcaaacagcatgaaggcagcaagaagaagaaaacaaaaaattacatatacttaagtaaacaggtaagaattacagcagaccttgtgagaagcaatacgagtcagaaaacaatgacatttgcactactttaaaagagtgtggctgggcatggtggctcacacctgtaatcccagcacttggggaggctaaggtgggcggatcacgaggtcaagagatcaagaccatcctggccaacatggtgaaaccctgtttctactaaaaatagaaaaattaggctgggctggggggccgggcacctgtaatcccagctactcgggagggtgagggaggagaatcggttgaacctgggaggccggggttgcagtgagccgagattgtgccactgcactccagtctcgc

SEQ ID NO: 15658 - DNA, 523 bp, Homo sapiens
atgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcggcggtgctggagtacctgactgccgagatcctggagctggcgggcaacgccgcccgcgacaacaagaagacccgcattatcccgcgccacttgcagctggccatccgcaacgacgaggagctcaacaagctgctgggcaaagtaaccatcgctcagggtggtgtcctgcccaacatccaggctgtgctactgcccaagaagaccgagagtcaccacaaggccaaaggcaaataatgtctccatagaatcactttccaatacaacggctcttttcagagccacctactatttctgcgggagagctgggccactggttaaacatttggaacgtttgttatgaaaagataaagcatttttcatctag

SEQ ID NO: 15659 - DNA, 5371 bp, Homo sapiens
  misc_feature (3635)..(3635): n is a, c, g, or t
  misc_feature (3752)..(3752): n is a, c, g, or t
gacatccaaacggcaagacaatggctaaacttagtataaaccaaagtccccgagggcagtagtaacaacagaatgcctccaatgagtgtttcaataggctttgcaaaatactgagtgtcattgtatgtatgtgaggcccttaataaatatcctttagtggtaggggaaatgggccagaaatgttcagcagcattaagaagagtattcgttcattttgagatgacttctcaaagctgcaaactagccagttgtgagcttgcatttgagtgcatgtgatcctgctcttttggtgaaaaattgtagccctgttttgttaaattgcagtctccagggtttcggttcctactatgaacctagagaacaggccagaagcatgttgcacaaggcttccgttttcactgtccagtgactggtatccaaattcccagattttcgcagtaaacttcactcagtcttgttataattgttatctgtaaacatttttattcagaatgttcttaaatgaactcagggaaagctgtgcattaaatagacatttaacagatggtcaagagagtagtattctgaaatttggtaaaactgcactaatgatatttatatactacactggagaaaacaaaacaaaccaaattaaaatccaatattcgtatattttaaattatcattactgtccataaaactatttgaaataataatttcttgttagttttaaaaatgaaaaaatattattttatataaatcctccaaatcccaaatcttcaaaatccaacaggatatatattgaaaagagttataatttctttaagttattaagaaattgagatatctcatgaataatataatttaaaaatctattggctagtaagtactggcaaagtgaatatttaaccaatcttctgaaaaaaattaaataatacaagcacttaaaagtctaagattctaagacaatgaatcattttgaattggccaaatgcatcataatttttccagaagcttgttcaaattttatttcccattcttagaaaaatacagaagataaagctgggtatagtggcacatacttgaagtcccagctgtttgggaggctgaggcaggaggatcgcttgagtgtgtgagttcaaggctgcagtgaggtatgatggtgatactgtactccagcctgagcaacagagcaagacaggaatctcaaaaacaaacaaacaaaaaagattagactttatgggatgacacaaagaaaatcatcatcccatcttcaattaatgttgaacagtgtcttaaatagtgcagaatgaatgaattttatgggagtcagtgtttcctagtttgaaagtctgattattttctgtcctaaaggaacatgttagagggggtctccagagttgctgaaacccttactccatatattgcaagaaaactcctcgagtgtagtttctgtgtctgatgagtatctctctgcagcacacagccaagggcctggaccatagaaaatatccagaactgaggacttctcctgccaagcccagggagtctgaatgtgagtccaaggctggcagctttgtatgacttcaaccatcacacatatattgtgagagagaaaatgaggctttgtgtctcttatgcctctgatttttagaaacgggtctgggcagtgtcaaagagtaaaacagcctttgcgcatcttaaccacaggtgtttgccttggcctcaattaacactgcactgaatcacccaactgagagtttgcagtcactgggctagactcccagagaccgcactcaggctgtcctcaggccgcgtgaaagcctagagatatcttggtcagcagcttcgctgggactccaaactcgagaaggggaatcaagcaaggcactttggcatcaccagtgtgaagaatctccagcaggggaggcaacagaggtagcaacattgtggccacggttgtgtagaatgcattgcatccagcacactggcacatacatgcttaaaccacacacttgtgtgcgtgtccctgcaccaggggcaaagctcatccctagtttatgagtagtgcctgacaactggcccctgtccttggccagtcccaagcccgtacgggcaacagggcacgtgtttttgagcctctctcccacctttcagccctctccaggtgtctttgggaaggattcttggagcttccccctgtcgaactcgtctaggatctccatgggcgagcgcggctggcggctggctagcctgggcggcctgagagcggagcaggctctgggcggggctcccgagggtcttggcgcgctggccgccacccaccctgaggccggaggggggcgggggtcaccaaaggcggcgggcccgtcgtgcggggctgcagggatgcaccctctctcccctattttttttcattggccggttatttgcatatttcaataatctttgcagacattccattgacagcagtatgtcaatcatacaggtagatcaatgaagacctaggtcaacaatagatgtctatataaacgtctgaaatagcaaaagttgctgcttataatgtttgcattcatgttgtggtagaaagtccattaaccagaataatttttcagaaaacttccatatattaaattggatggattatttaaggagtgttaaacgttttttaaaataatagaatacaataatatgtatctatataaccacagcttgggagagtcttttccatgcatgaagcaattgaagaaatcttaaagaaaaatcttggttaattctatcccacaaaactgctaaaagttataaaagcttaatttatggtgagaaaaataccaaaaatattaaatttatattttctgttctattgaagcaattagaacaaatgcaattttaaaatattttaaccaatttatgagtataaactcttgaactgattaagaatggatcataaaataaatttacattcatgatacagttttagagtgagaatgtaaaatgagatattgaaggcgtgttttctaataatgaacctcaatgaggcttaagagagtgaaataatatcctttggattaatgtttaatcgaaactaatatttactgctctagtgcattcaagagagcctgttactaggtttttgaatgtatgattgtgtttcagaaccaatttaaaataactagatgagtgactttagagaaaatgacaataaggttgtatagaaatagatatttctttcgaggttttactttagaaaatttgaaaaagtaatttctattctgccacagttgtgtgatcctctctgcatataaaatggtatttcctcacttataaaccccaaactcttctacagtgaaggtaatacacgtttagaatgaacactgggatgtgcttaaaatactcccttgagatgctggttgctttccagagggcagttctctgcctcattgaatggtggattcactggttggagtgcgtgttttcttttttgatagacacaaaacccacatactttgaaaatcttctgtgttaaatgttctgttcaaataagagacttatcccagaaacaagagggtcctggccacagccattcattacataaaaaggaaaagaaagtagacattttaggtacctttatccttgcttcctaattggctacctangcttgccaggtacggcagaaagataatcagactttctttttacaggatattaaagatgagaaaggccttggagatgatcaaatccaatccctttattttctaaagaaactgaggctnggaataattgacctgacagatagaaactgatggaaaattttagttctgttacttacttgctgtgagaccattttgaaaatagacatcatatcctgttttaattaccctagacttcagaaataagcattccaagataaacctatctgtatctgggggaataagagtaggctcagttgacagaagacaataggaaaagtaacacataaagatgtcaccagaagacaaagctctggatttaagatttggaagttggaaaaactcttggaagcttagcaaaattgtatataaccaggcccatatgaaatggagtgctgttgcaagttactgtgctgaggaagttgaggctctaagaccaaaatgttggcaaatggcttggatttggaataatgaagaagagaggccaagagccaatcctaaagtaatgacaggaagttggtgggtgtcccagagagaggtcacttctggtaaggagcatagggagagaatggaggcagaggagtcctgtaaactaaaatccagtgatttgggaataaaatgagcctcccagtttgtttgaataaagtacttgaatccaaaccaacattttcttgctcccaatgcatatatcaggataaaacattttgacacatcgtaaaatgcatataattcatagatacaatactttacacaagaatataacacatcatattgttcagatactcatatgcctagtgctaggcattcaaaaatatttgttgaataaatgaaaactcccagctctgccacttacttaattaaccacaaaaaaaattgtgtcgtcagtaaaatggatatggtgatacacacctcgtggagtgagataatatacatgaagtacccggaacatattaagcatttgataaataatagctgttattgttgttttaagtatgggtcaaacattgttgtaaatgctttataagaatttaaaatttataccacagaaaacattttctatgtcctgtgagaaatatgtatgttttgtattttaaagagaaaaatgtgtttaaataaccagtcaagtgtctgatacacatcatcttgactgtatattagattaattcatctataattaatatgttagtcatttccaagaccaatgtagttgtctaccacttcctagcacacctgggctgcacaaatatgtgggtctgatataatgtcagaaatgcaggaagctatatgagattccagccctctatttttccaagtgtaaaagaacttatgaatcaagagccgaataaaaaacatagtactctttctgataatctgtcaacaaatttgcaatcatgtcaggcatgttatatgattacgaattgctcaatgctattatgaaaagtattttcaacaagtgaaacttctggagttctctgcagttctgggatcaaacctcagtgccttgtcctaacgtcccattaggacagaagtgcccttcctgagagtatggcagcataatgacattctagcacctggaccgattacactgctctccctgaagtagtggattctttcatcagcaggagagagaagggtgaattgtataaagtggagcctgacagtgtgtattttattctttaaaataaaaaaattaagaacataaa

SEQ ID NO: 15660 - DNA, 377 bp, Homo sapiens
ttgggccttccgccaccgacgagctaaactcaggctgcaacaacagcagcggcagcgtgaaatcaacttgttggcctatcatggggcatgccatggggctggtcctttccctaccggttcactgcttgaccttcgcctcctcagcaccttcaagcccccagcctacgaggatgtggttcaccgcccaggcaccaccccccgccccccgcctccgtgccttatactgtcgccccaggccgccccttgactgcttccagtgaacaaacctgctgttcctcctcatccagctgccctgcccattttgaaggaacaaatgtggaaggtgtttcctcccaccagagtgccctccctcatcaggagggtgagcctggggcagg

SEQ ID NO: 15661 - DNA, 371 bp, Homo sapiens
gtcaccaggcccatctcattacattgccaacaagttatacaataatcatggacattgcatgtgcacagtcacattgcaatgaatgcacatagcacagcaggcctgaccaagtaagacacctgccatcctatgacctctgggtctttccctctgcataactcttcctttgagactgaactcctgcatcctctgtatgccatatcatctcactggcttcttacaagcacctagtgaagagtctccagtttggcagatgagaaacccaaagctcagagaggttaagtgagttgcccaaggttgcacagccacttaagccaaagccaattatcttcatgctgtaccctaagcctgttgagctgactgcaagggtt

SEQ ID NO: 15662 - DNA, 237 bp, Homo sapiens
tcgtcccagctacttggaaggctgaggcaggaggatcgctccagcctgggtgatagagcagaaattaaaagttttggttgtacttaaccaaagcctctgcatggttaaattttctcttgttacctggaaattttctaaatgtccttaaatagggtacaggttaaataaattcttgtatggtacagccttagagctgtgatgaaagtatggaatcaaaccactgatatttgaaccact

SEQ ID NO: 15663 - DNA, 544 bp, Homo sapiens
aagtcaggctctcaggagcagaagggccatcagtcatcgtttaagctcctcgggtgctcccaatgcatagtcaaggttgagagctactggcctggagccgtgcctggtaacagtaggtgccacctgcgtgttagatgtggtttataatggagacacggtgcacagctgctccagagagacacatctgggcagttacagtccagcacagcagtggaggcttcccgcggcagcaggagagcccacaggaagctttcagctcagtgaagggagtcaaggtcaggcttcttggaaggaggttggacagggcagctttggcctctgagtcttgggggcctccccatgtggaactgtgctcttaaaccagggcatcaccacctcaacagatgccagggtttcctggtaaatgtaaaatacacaagtcaggcagggcacaggggcccacccctgtaatttcagcactttgggaggacaaggcaggaggattgttagaggtcaggagtttgagaccaacctgggcaatataatgataccccccatctctaca

SEQ ID NO: 15664 - DNA, 373 bp, Homo sapiens
cacaccctaccctctgcaatccactctgtctcttgcttagggccactactaagtgctctcttgtatccctggctgctgtggctgctttaccagctccaccatgctgcattctcaacacaaagtgctatccactctgcagttctgtcatttgcaactagttcccactaggaatgtcagctctcagaaggaagggacagtctagtccatggctatattcctagaactttgaacagtgcttgacttttagtaaccacttcataaatatttcatcccatttactcagcaaatgtttgttgagcacctagtatgtgccaagtacctttctaagcactagggacacatcaatgaacaaaatggattaaaaaaactgctt

SEQ ID NO: 15665 - DNA, 477 bp, Homo sapiens
tagccatctcaggcatgggctttgattcaacatgtcattcaactctctttgcaaacatggagagtcagaaagtatttaagaggcttcctaccaccactgcatcagatgaccccaggagagtccaggtcaggtccatggtttgctgtgcatctatttattacaagaggactctgcctcatgtcttattcatccaactcttcacaactttttagtaggctctgtctgaagtcttgatgaggctcaattcccattggcctgctgttattagcatacctgggaattttttaataactgtcttatctcagaatgctgtaataaaataccatgaactgggtggcttataaacaacaaaaatttatttctcacagttccggaggctaaaagtttaaaatcaggatgccagcatggtcaggttctggtgagggtccccttccgtgttgccgactgccaacttctcatcatatcctcacatggttt

SEQ ID NO: 15666 - DNA, 161 bp, Homo sapiens
tctgtacttgacatcttttatggcttctgctcatcttacaagctacttgcttactcgttctctgcacttcatcttttcagttttatacaacccattcattttcctgtcacctattacagaattgaatatcctcaattaatatgactaatgttgtaacttca

SEQ ID NO: 15667 - DNA, 376 bp, Homo sapiens
aaggactcaggagctttcactgtgttcaggtttcctccattggtcaaatatgggatagtttaagaatcaaaagaataataacctgagtgaattgaaacaaaccaaatatatcttaaactaaaggctcttaatacttaaatgaaaaatcctcagcaattacctttgggagaggatattagaaaaccagctcactgttttgaaaacgtaagtgaagggaaaaagtcaagcatttattctgccccttttcgaagtacggtactttaggataaccagataattgtggggttatcctaataattgaaggaatatagtaataagtaatataagggatgtttctctttacagaatgagtgatagaataagagtattactattt

SEQ ID NO: 15668 - DNA, 373 bp, Homo sapiens
cacaggccacccctggtttttctcagtaatagattcactgttcattcagaagtctgcagggaaaaaaagcatgagctctgttaaagtttctactctacccaccccatccttccaaatccctcatcccaatcccagaccccacttcccctctagcattggactcagcaccgtggaaatcaatccactctgttattcttccagtgtctacacctgaccacatgttctggagtaaaatctgaatactcccctggattctgatctctaggggatcattgtgcaaaggctgaattggttttcctgcccatcgaacaacattgtttttgactgtaaataaaataggacaggaatgtgaagcgcctaaaatctgatataa

SEQ ID NO: 15669 - DNA, 306 bp, Homo sapiens
aactctttgttttagaaatgtgctagataagcttagtaactagcccaagctcacacagagagttagtgtcagccacctgccatctccacagctgcatctcaaacttctctgatgtagtattcctcttctgtatagagctcatgactatggtttttcactctccaacacaccagatgtacagcttccacattctctcattatctcacatttctttcagtcttcatactttctctaagttgtttatttttattatctcttttctggtgatgggaagaaggctcctactgaataacaacttaatagaag

SEQ ID NO: 15670 - DNA, 458 bp, Homo sapiens
tcagaatcctcctccccttcactggcctcctcctctgaccctcttccttctgctcactcagctctagccacagtggcctccgtgctgttggattccacctcagggcctttgcacatgctgccctcatgactggaacacttccccaacactcctgaggctctctccctctcttcttcaggtcttgcctttgcagtgaggcctttcctcaccactctgctgaaaactgcaacccattacctgacccagtccctttccttccctgcagagcactttccaccacacacatatgtcactccttgtacacccatcagtctgtctgggctagaagaatagctcctgcgggacaggggtttgtgtctgttttgttcgcagctgcattcccagtcctagagcaatgcttgtggggcctagcaggtgctcgctaagtgctcatggattggctgagagctgagttgact

SEQ ID NO: 15671 - DNA, 176 bp, Homo sapiens
tcacagggtaggaattctgtttattcactgcagtatccacaaccatttgcacagcaattagcacgtaagtgtgcaatagttacttgcttaaaaaatgagtaactctactacaatgaaatgggtgattattaaatctaggctgaagtgaaatttatattttcaaagaaaagtctgcc

SEQ ID NO: 15672 - DNA, 408 bp, Homo sapiens
cttcttgtggggtgcagacggcggcagctggctgccagtcttggggggaggctgtccacagagagctttggaacagagtaccccaggagaccatcctgttggcctgtgcgcgcccgtgactgcgttccgtgtgccgttgctctcctcctgtcctgggtgcccacccgtgagcaggagtggcaaggcgggtgccccgagcacttgagttgccttgtctgcggtcggccgtgcctggaggggcgtctgtgtcctgctcagctgggtggctccacgcttggtgttgggggctcctaagctcttgctgcgccacactctgggcagtctctgccatgccagcttttctagtcgcctctctcttcctgtctcatttatctctgagtcccacagtcgaagcgggatcctcaagag

SEQ ID NO: 15673 - DNA, 534 bp, Homo sapiens
cttcttgtggggtgcagacggcggcagctggctgccagtcttggggggaggctgtccacagagagctttggaacagagtaccccaggagaccatcctgttggcctgtgcgcgcccgtgactgcgttccgtgtgccgttgctctcctcctgtcctgggtgcccacccgtgagcaggagtggcaaggcgggtgccccgagcacttgagttgccttgtctgcggtcggccgtgcctggaggggcgtctgtgtcctgctcagctgggtggctccacgcttggtgttgggggctcctaagctcttgctgcgccacactctgggcagtctctgccatgccagcttttctagtcgcctctctcttcctgtctcatttatctctgtccttgttttgtgtttcttttcacacttggtctctgcccagccgtcttgtccacgcagcttcgtctgtattaactcctccagccgcagcccactcactccccgccgtcgtgatgccgagcacactatctctcgccgaagggatcctcaagacagccg

SEQ ID NO: 15674 - DNA, 378 bp, Homo sapiens
ccggcctggggcggggacgatgtgtatgtgattttgtgtctgtgtctttctgtgtgtgtctgcggtcggccgtgcctggaggggcgtctgtgtcctgctcagctgggtggctccacgcttggtgttgggggctcctaagctcttgctgcgccacactctgggcagtctctgccatgccagcttttctagtcgcctctctcttcctgtctcatttatctctgtccttgttttgtgtttcttttcacacttggtctctgcccagccgtcttgtccacgcagcttcgtctgtattaactcctccagccgcagcccactcactccccgccgtcgtgatgccgagcacactatctctcgccgaagggatcctcaagacagccg

SEQ ID NO: 15675 - DNA, 334 bp, Homo sapiens
atgcagtgaaatgattttctcattcagtaatgcaatgaaattgggattcatctaagaaaactggtgtagtgaaaaagacatgaactttgaggtcacatctccaagatcaaaccctagggccccatttcttagctgtgtgaccttggagaagttacttttgagtctcactttgtactgataattgtatttacttcacaaggtttttgaaatcattaaatgaggtaatttacgtaagctacataggagtgtccggcatttgttcatctactcaatttgtaaaggacctactacgtactagacacagttgtaggctctcacagaatattttatatat

SEQ ID NO: 15676 - DNA, 426 bp, Homo sapiens
ccaccaccagcgtgaccacatgcatagttgccagcaggggcctcccaaccccgcaagctgattctgccactgtggtgaacctacacggaagcaggcacaccagtacccgctagtaccctgcagtggctgagaagcatgcacctcaccgcgctgccactgctgcttctcacacatgcaaatgaagatggatcccactgccaccactctatgaaatgctttggctgacaccacacatcagaatagtgaccagtagtcagggagcaccttggccaagaagacaaagttggggcacgaaacaagtttcctagaccacacagtccaggaactaggagctgagcattggccccctaaaatcttccagaaatgaagctagtcgtctgaatccaccctgtaccacaatcaaacccttaaggtcaccaaatagga

SEQ ID NO: 15677 - DNA, 296 bp, Homo sapiens
taaatgctaaacaatctatctgatatattctctaaaaacatacagaatataaaatcatggttaggaatttgagctttagagctagacagaacttgactgaatcttagctctgctaagagctgtgactttgggcatgataattgacctcactagactcagcttccgcatctataaaatggataatgatagaataatgagtgatggtggtaagaatgaaatgagctagtatctgcggcacctaggacagaacctggcatgtaataaacactcagtagacattacctgctggtgtggta

SEQ ID NO: 15678 - DNA, 406 bp, Homo sapiens
actgctgtttgccataaaagtgtaggcgagatctgtacttcactgagtcggcaaggtccattgtaggcaatagaaactgatgtatgagggattgggaaggcctagaaacggcccaagaaccaggaggtctccagggacgcggagaggaagaattggtgaaagagaaccagggtctctttaggccctgtgcttgcggtgaacagtcacctgccacttctggccttcatgttacccactcaagactcagattgggctgagcatggtggctcatgcctgtcatcctagcactttggggggctgagacaggaggatcccttgagcccaggagtttgagaccagcctgggcaattagaagaccctgtctctatctttaaatatttaacattttaaaaacttttaaaaatta

SEQ ID NO: 15679 - DNA, 660 bp, Homo sapiens
atttctcgtgttatgctttgctgaacgtccttcctctctgcctgacctctgactgccagccctacttccgtgtgacacctgggggccttgctgtggccaggtcacctctgagctctgttcctttctgaagcagctcccacccatgggcctgtggggtctgactccaagtgcgagcccctcctctgatgtcagaagggcatgtcccctcctgcccaggcacccactggggctctatagcttccattcccctggctggattggaggggagtaagcctaccctctcaggccaagcgggccgccttcttgttacctggatacctggcagcctctgttctcaggacaacctgtggaagccccagagcgagccagtaaccaggtgccaggtgtttgcctgagaattaatcgttgttttctttctttttcagtggttgatatcacagcaagtatcctttccgtgttggtatggttccctttaaggaattctccacttaaataaaaagaatgtatcaaagcttgaatcccacctcccgacatgccctgtgagttgaggctcggcccacagagcacctggagtgtcccccacctggccctctgctgcccttgggcgctgtgctcctctttgtgcttctcttcgtaccttgcatccagctccaagccctg

SEQ ID NO: 15680 - DNA, 688 bp, Homo sapiens
ccaaggagattttatgtctgccctgctgtcctaggctctcagagatttagttctggccgacattactgggaagtagaagtgggaaacaaacctaaatggatattgggtgtgtgtcaagactgtcttcttaggaactggcaggatcagccatcagttctgggcggattctgggcaattgggcgatacatgaagagtggttatgttgcgtcaggtcctaagacaacccagcttctgccagtagtaaaacccagtaaaattggtatttttctggactatgaattgggtgatctttccttttataatatgaatgataggtctattctctatacttttaacgattgtttcacagaagccgtttggccttatttctatactggaacagattccgaacctcttaaaatctgctcagtatcagattctgaaagataaggaactggtaaatgggtctgtttcagtttttgtaggtaacttagccagtaaatttaatctcatttctggactctttaagttttaccactgaaaaccagagtcgatttttctcctaaatttttggcaactataagatgttcataatgccactttcatatattctatgaatatcaattgtcaggtgctttgatttctaagataaaatattttagaattatgttacttaacatgtccaataaaatgttttcaaattgcctat

SEQ ID NO: 15681 - DNA, 333 bp, Homo sapiens
tttttgagacagagttttgctcttgttacccaaggctggagtgtaatggcacgatctcggctcactgcaacctctgccttctgggttcaagtgattctcctgtcttagcctcctgagtagctgaggcatgagaatcactcaaactgggagcagaggttgcagtaagccaagatcacaccgttgcaccccagcctgggcaacagagccaggctccatctaaaaaaaaaattttaaaaagactactaaaaacagttttacacgcaaggtgtctaaaaatagtagaaaaaactttttttttctttttggtaaaaggttataataaaaaggtttttg

SEQ ID NO: 15682 - DNA, 402 bp, Homo sapiens
attattccatttaatcttcacaaaaattttcctttcacatataaggaaactgaggctcagagatcttagatagtttgattagaagtagtttgatgagtgtataaatgaaaaacagtatttggccagatgtggcagctcacacctgtaattccagcgctttgggaggctgaggcaggcaaatcgctagagcccaggagtttgagaccagcctgggcaacatggcaaaaccccatctctacaaaaacgcgtaaattagccaggtgtggtggcatgtacctgtagtcctagctactcaggaggctgaggtgggaggatcgcttgagcccaggaggtggaggttgcagtgagctgagattgtgccactgcactcccagcctgggtgacagagtgagactctgtctc

SEQ ID NO: 15683 - DNA, 573 bp, Homo sapiens
cagtttggggaagtcggggtgaagccccctggaacaccctcacactggcaaagaagctgcctcggctatctgcgggctccgctgcgttctccttacttttctccccctcttaaatggagttaaaatggctgaattccggcttttaattaaaaacagcctataatcgaaaacgtctcggcgtcccgggctcccccgccgcctgctgggaaccgagagaggaaccgccgcccctcggccgggccaggagggccggagcggggctgggggctcgcgtgggtgcccggggcccagcagcccacccccacccctcccggggcgccccctccccgccggccctggtccccgattctgcaatccggagccagacagtagcggggatccccccccgcgcaccccgaggggcaggcgtggttggggggcgagctggagaagtttggagaccatcgcgcccggccgggggccggcaggctgaccggcggcgtacctggcgcggctgggttcacggctccaggctccggcgacaacgactccggcggcggccccggctcccggcgcagctaggcgcccctgctg

SEQ ID NO: 15684 - DNA, 497 bp, Homo sapiens
ttacctgggagactgttcattatatcagagattattatagcagatggaacgttaaaaattgatctgtgtttctcacaaacacagttaatctaaaccagctgcttcttccttttgtacctatgtcttctaactttgcatcctcataaaaacacaccttcagtgaaaaagctggtggcatagcatgttgatcttccaaaatgccaaaaacttcagcacattgtttttgatgagttttggctttacgtattattttaaggagaggctaattcactgtatttcatggttttagtgtgcccctttataagtttttatgtctacttagttcttccccctttaaatagtttggatgaataaactttagaagtggaagattgtatggagtagctctttgttatgatgtcatttacttgctattcaggggagccacaaatgttggcttttaaatctacaaaatagtgcaattggccttatttcattaaattatttctgtaagtgaa

SEQ ID NO: 15685 - DNA, 336 bp, Homo sapiens
gaatcactgtacatggtggtcttgactggaaaggtctctaaggctggggaggaccctacttggcttggtatttggagcgctctctgtaggggctgcccagcagacagggcttcctgtcgtcagtcattgcctcccccaatcatgtcagagtctgctcaaccctttggaaaatatggctgggaggggacaaggggcttggggagagatgagcatttgtcaggtgtctagcactaggccaagtgctgggcatatagcggtgagtatgacctggtctttttctcactgtctgatgaaaggatagatgggcaaataaagtgggaacaaattcttacaagt

SEQ ID NO: 15686 - DNA, 325 bp, Homo sapiens
ttttccaatttggatgccttttatttctttttcttacctaactgctctggctaggacttacagactttttcagaaaaaccccaaaataatctaggggagtccactgtcactagatctgctttataagaaaccctaaagggagttcctcaaactgaaatgcaataagactaattagtatcatgaaaccatatgtagttataaaaagtcactggtaaaagtaactatacagtcaaattcaaaatactcctaatactgtaatgatgcagtataatcactttagcttttaaaaggttaaaagataaaaaatactacaaataaatataat

SEQ ID NO: 15687 - DNA, 862 bp, Homo sapiens
aaaaattgtacccccaaacctgtattatattcctattgctactgtaacaaattacaatgaactaagtggttcaaaacaacacaaattagttatcttatggttctgcaggtcataaatctaaaatggatttcactggaccaaaaccaaagtgttggcaggagtgcattggtttctggagactaaaaagatgaattttctgccatttgcactttacagaggctgtctatatttcttgattagtgattcccgtctatcttcaaagccagcattaaccagttaggtctttctcgcattgcattactctaacactaactcttctacttccctttttagcatataaatgatccttgtaattacattattagattattttagacaatctaggacaatctctttatttgtaaggttagctgactagcaaccttaatttcatctgtcactttaattctctctggctatgtaacaacctattcacagtttctggggattaggacacgaacattttttgggtaatgacattattctgcctataacagtctactttttggctccaaatattcacgtctgtcttacattccaggtacattcatcccattttaacattcccaaagtcttaattaattgtagcatcaaagcaaagtttaatagctcatcaaaatatcatcaactccaaagtcccaaatctccttatctaaatcagatgtgggtgaggcttttgatataatccatccagagtcacaattcatctctagctgtggtccactaaaattcaagaaattagttatgttcacccaaaatgaaatggtagacagactaatgataatagtatatattcactttcatttaaaatgggaaggaaaga

SEQ ID NO: 15688 - DNA, 496 bp, Homo sapiens
accctttttattcctaacgatggtttccctaaagcttatgttacccaattaatgtttgccaggtatatatttttccactcatactcactttttataacatttttatgcatttattttataaacatatacatggaatattttaaagcataatgcgacattctgcttttaaaccgatgagtttatatgatttgtgattattgatacagttggctgggtgcggtggctcacgcctgtaatcccagcattttgggaagccgaggtgggcagattactaggtcaggagatcgagaccatcctggctaacatggtgaacccccatctctactaaaaatacaaaaaattacccgggtgtggtggtgggtgcctgtaatcccagctactcaggaggctgaggcaggagaatggcgtgaacccgtgaggcagagcttgcagtgagccaagatggcaccactgcactccagcctgggcgacagagcgagactctgtctcaaaaaaa

SEQ ID NO: 15689 - DNA, 193 bp, Homo sapiens
tctgtgatttagacctctgattcatttgtgaggaagtgacttttactttctgagcctcagtttctgcatctatgaagggagcccataggttcccaccctgcccaccttgcagggtgcttctaagatgggcaaatgttttctcaaccacagtgctccacggcggaggctgggtatggttatcattgctgctcct

SEQ ID NO: 15690 - DNA, 389 bp, Homo sapiens
tgcttgtcttgaagaccctgatggcttctgaatacattcaccaaggcaagtgttgatacaatctctttttctctctagctaatttccagggaacagaagtaacacctaatcaaagaacattaccttcttccagaataggaagacctggcaattttcagaattgctatggaccaatcaatgactgcttgtgtgttggggggcattagataactttttttttaaattaacaggcctccagatcaagaagaactgcatctggaacaggtataaataataagatcctggaatttgaacttgatttcatacttatgattaaaagtatgggaatttcctaaaattatatttatatacaaaatgagacagaagtaagctattttgtgtgtgggtgg

SEQ ID NO: 15691 - DNA, 380 bp, Homo sapiens
tcctcaagtcacactgtaaactagctcatctctgtggtgtactcagtatcctacagtctttcttggccttccctgtacagttcagttttcacatattcgaacggccaagaccaggttcttggctgtgctatttggagaccaggcgttggggaggattcacgggttccacagctgcggggtttggtggccgtaggggaagcagtggtttgggagttctgaatgtaagcgccagagctgccctcctggtccgctgtgcgtggtacccagtgtgcatcacactactcaccccctcccggaccctggcagtccacagcgactccgaagtcagcccatagtcacatccaccacacctcagacctgccacagcctctcctcacttc

SEQ ID NO: 15692 - DNA, 477 bp, Homo sapiens
ttttttaaaaaagaatgccaaaaggtttatttagctgttaatatgacttccatatatttcaaaaaaaacagagaaaattgtctacatataatataaatgctataagaaaagagagaagagcaaaatattctcctttattttaaggtatgtgaataaatcctcttatttctaattcatattttttcctacaacagccatgtcctggaacatgttgaactgtcaagacgtcggaatttcagtagacaatgaattcagacatctgtggaatagccttgggcacactgtgtttatggggaaaaaagcagaagagaaaaatgtgttatataaatttatgggtgcaaataaataaagcaagttcttagtgacttatgaagacagactctgacacaataataggaggaaactacaacaccccacagacactaataaatggattactgaggaaaaaaaaaccacaaagatattaggacctgaact

SEQ ID NO: 15693 - DNA, 363 bp, Homo sapiens
ggccccaaccccacattccttcctgccctgcaatgtctgaagaaaccctacagagcaaattggcggctgcaaagaaaaagccatgtcctggaacatgttgaactgtcaagacgtcggaatttcagtagacaatgaattcagacatctgtggaatagccttgggcacactgtgtttatggggaaaaaagcagaagagaaaaatgtgttatataaatttatgggtgcaaataaataaagcaagttcttagtgacttatgaagacagactctgacacaataataggaggaaactacaacaccccacagacactaataaatggattactgaggaaaaaaaaaccacaaagatattaggacctgaact

SEQ ID NO: 15694 - DNA, 432 bp, Homo sapiens
ttaccaaactgaatagggcatgccaactatttctttacttctcagaagcccttgatctctataggatagatttggtaggaatatgagcgaatcctttccctgctgaatttatgtgttgggagtaaaatgggctgagagttattatctcttggtacagaacacctattagagaaaagaaagatggctgagctctattagcattagtatagaaggatttaaatttattttgtcagaggctactgaacttaatgtaatcagtgactttatgccccctttgcattcagtaaggaatgcataagttaatgatagatatggccgggtgtggtagttcacgcctgtaatcccagcacttcgggaggccgaggcaggtggatcacttgagcctaggagatcaagactagcctggccaacatggcaaaacccaacctctac

SEQ ID NO: 15695 - DNA, 539 bp, Homo sapiens
  misc_feature (496)..(497): n is a, c, g, or t
  misc_feature (499)..(499): n is a, c, g, or t
  misc_feature (501)..(501): n is a, c, g, or t
tctcctatagtgggagtgtttacatcacagaaattggcaaacagtacaaaccagagctctccctgtcgcatactgagaaccagcttacaggcacatcacagatttagacccattataacctgtaaccacggcactctgcagggcagagctcagggctggcaagagggaccaacggggctggttccattcgtttatcacaaaggaaagactgttgcctgaacttagcctggtggcccttgagtctggctagagactgattcctaaggccagccataggccgatggctgtggcccctgtctgttcacctagacccaaactcagcttcaagtccagtccgtttcctgactccagactcagttgccattgcatgacccacataaatcctctccacagtctgccaggtagcaaggagttatccctcttatacagatggagaatctgaggctggagaaagaaaagacaaggtcttacggcacatgtatacatatgtaactanncncnacgttgtgcacatgtaccctaaaacttaaagtataatt

SEQ ID NO: 15696 - DNA, 576 bp, Homo sapiens
ggcacgaggagagagagagagagagagagagagagagagagagagagagagagagagagagagagagagagagagagagagagagagagagagagagagagagagagagagagagagagagatgtttcattctgagtatttattatctttttaaatacacagtcatgagtcactgaacaaggacacattctgagaaatgcgtcattaggtgattttgccattgtgcaaacatcatagagtgcatttatccaaacctagaggatgcattttaaaatttatatattcttacatggaaaaccaaatgtcccagcaccgttactgaatatcagtcatttccccctagttgatctgcaaggccaatatgaagtgctatctgtagctttctttatatgacccatataatcttatgggaccaccgtcatctatgtggtctgtcattgcccaaaacgtcattatgcaacacatgactgtaatttaattttgtgtatgtaatttaattcttaacagtggctatgtttaacaaccaactcacaaaatgcctaaaaatttaaccaccagttcttgcaagccaaaaca

SEQ ID NO: 15697 - DNA, 574 bp, Homo sapiens
ctaaactatttaaatcctatccattcttcaagaaatgtttcatgacgcttccttaactgctaaggacccgcagattctcttcctcttgggactcacacactgactcatctcccgatcttttggtgctcagcaaagtggaggcctctgttttggacttagagtcaagaccattaaataagactatgctctaaaaagtacacctccgtggcccggaacgagtgaattaacatctatgagtttccatttccttgtctataaaattgtgaaattgcaacttaagattagttctgaagattaaatgaggtaacataggtgaaaatgctacatttatgtaagaaattactctttcataaggatgtcaatgtttaaatacgcattttctcaattttgttaatgaaatactttgaaattcttttttctaatgaaacctgctgaatgtaaaagagacccgtactaaaggaagataccacatgaagcaccagggtctctttctggatctatcatgactcttgtgactgtttcagcagcacggaattaaggcgattgttattctggaggaagacaatgagtctca

SEQ ID NO: 15698 - DNA, 495 bp, Homo sapiens
aggccaggagttcaagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaaccaaaagagccaatataacttt

SEQ ID NO: 15699 - DNA, 204 bp, Homo sapiens
tgaaaattcagatttcctcataaatttatctcaggagttgtcataataggtttttattttttatttttaaaaagggcttttctctaagaagtaaggctatattcctgtcttagtctatttcatgttccacgcctcagtgtactgaccaaacagggcattgatagttaattagttcagaaatgtaagctgtatcattcaagaatt

SEQ ID NO: 15700 - DNA, 395 bp, Homo sapiens
ttattccagatggaggttgattctagtttttactgaaaactagaatcatgtgcatctatgtcttcacacccctcttcctgccccacttctcccttttctttctttctttctttcttttttttttttttttgagacaaagtctcactctgtcacccagactggagtgcagtggcgcaatctcggctcactgcaacctccacctcctgggttcaagcgcttctcctgcctaaaaaaaaaaccaaaaaaattagccaggcgtcatggcacacgcctgtggtcccggctactctttaggctgaggcagagaattgcctgaacctgggaagcagaggttgcagtgagccaagatcgcgccactgtactccagcctgggggacagagcaaaactctgtctc

SEQ ID NO: 15701 - DNA, 525 bp, Homo sapiens
gagacagggttctctctctaacacccaggctgaagtgcagaggtgtaacttcagctagttgcaacctccacctccccggctcaggcaatcctcccacctcagcctcccaaatagctgggactgccaccacacccagccaccttttttggttttggtagaaacagggttttgccattttccccagcctcgtctcaaactcctgagctcaagcaatcttcccacatatgtttgttctgaagtctactttgcctagtattaatatagccaatgttttttcctttgagtagtgtttgtgatatatctttttctttacttatgcttttatgtatcttcatttctaatgtggtatacatctttatagattaccttcaagtgatataccactttaatgtgttttataagaaccttagaacagtatacttctctcatgccttgttctgttgttatatattttaaatctataatgttttaaaatcaccatacatgtttataatttttgctttaaacagattgttgtccttgttt

SEQ ID NO: 15702 - DNA, 409 bp, Homo sapiens
gctctaacttccagcttctctgaccagatttcatgctcctcttcctttatttggcttctttgggtaatccctccctggtttcatctcaccataggcccttttattgcagtgcaggctgcaccctcatcaaatttccctcagtcctgtgatcaagccccagaaaagcagtcccgagcaggccacagcaccaccctccagcctgaacaccgagatgtattcgagggcctaggccttatctttcaccctagagacttaggaacatgctatagaaagcagccatcagagttgtccagatgaccactgtaattttatcatgtgctttgccagcctgcctgtactccttactgccatcttgctagcactggctatgccactgggggagtttgaaggcctccttctccttgaaggt

SEQ ID NO: 15703 - DNA, 173 bp, Homo sapiens
aagtaaaaatggtattccatgagaaaatttcaaatcagttgcacaagtgttttcctctagataaccactgtatctcagtgtgcagcaagagtgcttaatacatccttcccatttttcatcacacagaacaggaaaaagactcaacggccaagatccaaaatttaatagataat

SEQ ID NO: 15704 - DNA, 339 bp, Homo sapiens
ttggaaaaagcagatggttgagttgattcacattcagagattggcagaagagatgcaatgtattaaggtcatggagtggaaggaattatgagtgctagtaagaatgtagctgaaacaactgatctcataaatccaaactggcaaggaaggataaaatcagcaaggagctaacagactagacaaagagaattcaagaagactagtgcttttaagaagttgggccaggcatgatggctcatgcctgtaatttcagcactttgggaggccaaggagggagggtcacttgaacccaggagttcaagaacagcctgggcaacacaggaagaccccatctttaca

SEQ ID NO: 15705 - DNA, 313 bp, Homo sapiens
ttaggatcatataataaaagatgatagaaaagatctaagcaaaacataaatctctgagttattttaaaatgcttcctaatttaataataacaacagtagggctagggaaaaacagaatatgttaagtaattcagaagaccttctgcttaaatgcaaaatgcactttacacaggattttacaaaataatgtcagcccaccacttgcagttctatgtaagagggaaatttaattattatacatttaaaaaagagattagaaatggtaaattgggtatgtttggcaaccaggatgcttatggagtaggctttgttg

SEQ ID NO: 15706 - DNA, 427 bp, Homo sapiens
taagagttctttgtatattttgggtaacagtccattatatcaggtatgtcttttgcaagtattttttccaagtctgtggcttgtcttttcattaagtgtctttcacagagcagatgtttttaattttaaagaactctaacatataaattatttcttttatggatcatgcctatggtattgtatctaaaaagtaatcgccagtcttggggtcatctagattttctcctatgttatcgtctaggagttttatgttttgcattttacttttaggtctgtgatccattttgagtgacctttttgtgaagtatgtaaagtgtgtgtagattcatatttttgcatgtggatgtccagttgtttgagtacttttttcatgtgcttattggccatttgcatattttttgtaaagtgttcacatattttgactact

SEQ ID NO: 15707 - DNA, 594 bp, Homo sapiens
atgggttcaagcgattcttatgtctgagccacctgagtagctgggaccacaggcatgcaccaccacgcccagctagtttttgtatttttagtagaaaccaggttttgccatattggccaggctggtcttgaactcctgacctcatgatccacccatctcagccttccaaagtgttgggattacaggcatgagccacctgtgcccagccaaaaaaactttttctaattaagtttttgttattgttgttgttgaggcagggtctcagtcactcaggctggagtgcagtggcgccatctcagctcactgcaaccttcacctcccaagttcaagccattctcatgccttggccacccaagtagctgggattacaggtgcataccaccacacccagctaatttttgtatttttagtagagacggggtttcaccatgttggccaggctggtctcaaactcctggcctcaagtgatccccctgccttggactcccaaagtgctaggattataggcatgagccactgcacctggccaagcataaatgtatttcttttctttactatgcaaatgtaactaaacaagacagagtctccatctca

SEQ ID NO: 15708 - DNA, 571 bp, Homo sapiens
gctttgaaggaatgtgagtccggcaactggtggggaaataaatatttggtcacttctattgtctcaaatttatttccaagcattaatatgaatcttaaggctacaacaaaataatgtatcttgtaagagagatgaatggacaggaaaaaaaattagaagtcttcccaaccactcttatacataggggtagaaaatgctcaatgttgaccggaaagaaatcctgtaaatatgatgtcaaaacattgtcattggtagtcatctatcatctgtaggttgctctgactttgaagaatccctgcattgggaattgaaaatctgtgaaaactaatttcccctctatgtcactgtatctcttctaaatatgtaagtcccagccgggcacaggggctcacgtctgtaatcctagcactttgggaggctgaggcgggcagatcacgaggtcaggagatcgagaccatcctggcaaatacagtgaaaccctgtctctactaaaaatacaaaaaaaagttagccgggcgtggtagcgggcgcccgtagtcccagctactcgggaggctgaggcaggagaatg

SEQ ID NO: 15709 - DNA, 823 bp, Homo sapiens
ggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagttta

SEQ ID NO: 15710 - DNA, 2511 bp, Homo sapiens
ggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctggtgtctggtg

SEQ ID NO: 15711 - DNA, 784 bp, Homo sapiens
ggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaaggccaaactttaggcaaagcattcattcaataagtgtgcacacagaggctgaaggccctttggtc

SEQ ID NO: 15712 - DNA, 2005 bp, Homo sapiens
ggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctaagggctagcaacactcagataaacaaccgctctggacagctcagcaccaacacttctgcggaaacttgggctctattagctttggttgaagctactttctggatgcctagttactgctgatgtctagacattagcttcagctgaactttcaccaactctcaggcattaaaatgtcgagtcagacaggttttctttggctactgcagttggagccagcgtcgac

SEQ ID NO: 15713 - DNA, 955 bp, Homo sapiens
gtatagtttgaaagatgaggatgctttatttgcaaactatcttaacaagggattcgtaaccagaatatataaggagctcaaacaatagcaaaaagaacaatccaacttaaaaatggccaaaagatcttaataggtagttttcgaaagaagatacacaaatggccgacagatacatcaaaaaatgttcaacatcactaatcagagaaatggaaatcaaaatcaatgagataacatctcaccccaattcattacttttatcaagaagaaagaatgaatgctagtgaggatgtggaaaaaggagagccctgcctggtacactgttgggaatgtaaattggtacagccactgtggaagactacagaggttcctcaaaaaactaaaaacagaactatgctccagcagttccactactgggtatatatatatctccaaaaggaaagaaatcaatgtatcaaaaagatacctgcactcccatgtttattgcagcagtattcacgatagccaaaacatggaatcaacctaagtgcccatcaatagatgaaaggctaaagaaaatgtattattcagccataagaatgaatgaaatcctgtcattggcagcaacatggatggaattggaggtcattatgttaagtaaaataaaccaagcacagaaacaaatattgcatgttctgtctcacataggagctaaaaaagtggatctcaagaaaataaagaatagattggtagttaccagaggctaggaaggatggggaggatgaagagaggttgattagtgggcacagataatacagtttgaagaagtaagactggtgttggatagatcagggtggcatagttattaatttactgtacatttcaaaacagctagaagataattttgatggtgcctaaatcctgtaatcccaacacactgggaggatcagttgaagccaggagttcaagaacagcctgg

SEQ ID NO: 15714 - DNA, 465 bp, Homo sapiens
  misc_feature (19)..(19): n is a, c, g, or t
  misc_feature (27)..(27): n is a, c, g, or t
  misc_feature (46)..(46): n is a, c, g, or t
  misc_feature (72)..(72): n is a, c, g, or t
  misc_feature (189)..(189): n is a, c, g, or t
  misc_feature (191)..(191): n is a, c, g, or t
  misc_feature (211)..(211): n is a, c, g, or t
  misc_feature (227)..(228): n is a, c, g, or t
  misc_feature (230)..(230): n is a, c, g, or t
ttttttccttaaaagtacnttaaaaanggaaatttgtttgtatttnttatttacattttatatttttgtacnatattgttagggtccagcccatttttaatgatctcggatgacccaaacccagccttcggagcgttctctgtcctacttctgactttacttgtggtgtgaccatgttcattataatcncnaaggaggaaaaaaacccttntaaaaaagcgcaaaanngncaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagtcctaaa

SEQ ID NO: 15715 - DNA, 1672 bp, Homo sapiens
  misc_feature (911)..(911): n is a, c, g, or t
cttgtgtctagcccgtgattgacattctagagataatatgagaaatattccagacctgaccttagagtttgtaatccagttgggagaaacaaagccttttatgcaaaacataattagagaaccaagcaatatcatctataatctaaaagtaaaatgtgaggtatgtttttaattccaagagcctgtgagtggttctgaagtgcaagtgtcttcttgtgtttttcagaggtttgtgtttagatggctcaggtttaatctctaatggggatagcagggaaccagatgagacctgctgaggtggccacagtactgattctagtgggcaggctgcctcccctctgatactgtgtaaggcattactaatgctggcaacagtttgcatatagccaattgccaaaagcagcctgcacatccctcctgaggctggtcccgtaaattcttctctttcctgtcgtaaagcattcctcatcaccacctcccttttcacactttatgcaaggccgtgcactgggacagcaaatggctgcaactttcactgcttgcttttcccaagtcgaagaaaagttccaacgctggcaaagcaaggacattgctattttctgacgatcgaatgtcttcgaggaactagcttcagtgctgatagggtctgtgttcctctagtaagaatagcactgtttccattagaggggaccaggatgggtagacaggctaagacgtctgattactctttgctctgtgtatttgtatgacagctcgggtgtctggcttaccttcctgaggatgagagccatagcattatccatttaataacagccacagtgacagtgctgataatggctagcatttacctagcactgtgtgccctagaacatttaatagtttcactctatgaactcgtttgttggtcttcntgccatgtgtccaacataaagctagcaggacccatctgtccttgcccatgcttattctgtgccacagccacccctggttgtgattaagatattaatgttaaagagggaattgagttctgatttctcctcattcaaaaccattctgtcatcttcatgcacatgccctgcaggcagccagccagtaaggggtccttcatacctatcctgttcctggctggtggctctcagaatctgccatggctctttgatcctgtttgtcctcctgcccttgagtgactggctatcagaaaagccttcatttccttgttggattctgcctccaggaagcaaagccgacccagtggtttctgtgggtcagctgcacttggctgtctgcactggggaagagacttggcttgttggctgttttatgccctttggactgtcaggtccaagtgtactgttggccgcagcatccagtctgtgctatcagagcaaggcgctatggtcaggagacccttagccaccaaaggtctgttgtctcctggtgtctttgcctgaagacttctggccttcttgtgtttcatcactaagtgcatctataagctgacccgctgccaggtatcatgtctgagcattttggcaaggagagtcggtgagagaagttttcttggcaaccataaaataaaagtactatcaggagctgctaaataaatttgcaccgcttcagccagggaatttcagctctcctgggtgggatagtgataggggatgtggaatgc

SEQ ID NO: 15716 - DNA, 208 bp, Homo sapiens
attccatttatactaagtgtctagaagaggcaattctacagggatagaaagcagattgttggttgcctctggctggagaatgaggagtgaatgttaataggtactttttgggggtaaataaattgttctaaggggatggtgatggttgcataacggtgcatatgctaaaaacaaattcaacttgggtaaattttatctcaaggaataa

SEQ ID NO: 15717 - DNA, 745 bp, Homo sapiens
taaaaaataagcttaagagtagaagggctctggtttcccggagctgtctagagtcatggaaggaaggccgccaatatgagggatgaggatggccacacagtagggtgacttttcaataaaataacttttttgttcttgtcacatttagtgagcttactgcaactactaccctaccaaagtcactgacttcagtaaaccatggctcagccatatgatgaatcatccagatgatcaaaattattcttatgaagagcttttaacaacaaatacagatacttgtgatataacactgtgaacaaaagcaagatatacaagggcatttgcagtataatgacaactatgaaaccgatccacatacgagaacagcaatactccaaaacttcaaaaggtgattagctatagatggtgggattctagatgatttttgttattttctagaccttgtattgagtattctatagtaagtatggattcatttttataattaaaaatatatttttaaatggaataaaatctataaaaggcatcacctacttctttcaaaggtcacatattccttaatcatggcttgaagcctcagagctaaaatggcagtgttcaaaatatacatctgctttagaacctattttcttcaatctttcctatgatacttaaaatttcatagaccttcacagaaatgtgggaggaaatctgttagtgactttgtacacgcacccagatgatctggaactggtactctccagtg

SEQ ID NO: 15718 - DNA, 510 bp, Homo sapiens
gtgagttgtgaagacgaggggctcagtcttccgattcatgcaaagggttgatgtgacattttcagagcctagttctagcttcattgtgctggaaagtggtcttggcctgaggacagcagggtgcttcagagtccagtctgatgccctttggcagccacacaccctcctgtgaaggcaccacaaattccttgggagggagacgcgttccagatgtgtatgccgcctctagagaaaacgtggcttcttctggtgagccacatgcaaggtgtctcgctggccactgtgaagtggggagagacgcctggagcaagccatgatctctgccagcactggaatcaccaacatccttgagcttccttcagtctgatgcagaacctgaggacgtggccatctcttggtggtgttctgggaaagcaggaagtcttcagacctgattgtcttcagatttcagccatgggctccctggtgagccatctcaggggtataggaaacatggatgccgccccggag

SEQ ID NO: 15719 - DNA, 435 bp, Homo sapiens
cacacaattaacatgcaacacactagcctaaaatttacttattcggtattagtggaacaattacatgaaaattacaacattttgaaaatataaaaataataaaaatttgattattatgaatattacaacataatatttaattctcaattttttgaccaacgagaaggccttatttatattatgtttgtggagtatttatagaaattgatattctgagcactatagtaagtgtcaatgtatttcatgagataaaaaccatatattgtatgttctctgataataatgaataaaaccaaaactagaaagaatgtatttttggaagtttcaaaatacacttctaattaaccctgtgtcaaacagtaaatcaaatcatagcataaactattgaacatttaactgagtaatattaaaaaataaagttgaagagtgctgatt

SEQ ID NO: 15720 - DNA, 729 bp, Homo sapiens
tatcaaggaaaacatgcttaggttatcagaattgtgaaggccatagtacaaaaagttaagagaacggaactcaggatctgagaaagatcagccattctcagcatgttgccttggctgcttaaccttactaaacttccatttcctcacatgtaaaatgtacatcataataactagtctactgagataagggaagaatacttagcacagtgctagtacactgtaagtactcaaatgttacagatccaagtattttgtaagaaaataccagcaaaagataaaagtttttttatggatcgtatttgtatcaatcacctacatgatctagagccctcacatggataacatttaaatgttcagtttgcctaatagccttcaatgaaacacggattcttctacttaaaaaaggtaagcctggagaaaataaaactgattactatgcaagaaaaaaatgtgctctgctgtgctccttggtatttttaagtggtttccattgtcttaacacctgtcttaaaacgggtatgttgtttgcactgaaccctcaaaagtatttatacctattaagttaaatttccctttttagagttaatgcttcattgcctgtcggcatattatcactatctgtctttgaaaaattttcttttaagtctcaactatttcttcataaagctcttgttcagagaaacattttttgatttgtccaatggactgaaataaaaggttagtaaacca

SEQ ID NO: 15721 - DNA, 443 bp, Homo sapiens
tatcaaggaaaacatgcttaggttatcagaattgtgaaggccatagtacaaaaagttaagagaacggaactcaggatctgagaaagatcagccattctcagcatgttgccttggctgcttaaccttactaaacttccatttcctcacatgtaaaatgtacatcataataactagtctactgagataagggaagaatacttagcacagtgctagtacactgtaagtactcaaatgttacagatccaagtattttgtaagaaaataccagcaaaagataaaagtttttttatggatcgtatttgtatcaatcacctacatgatctagagccctcacatggataacatttaaatgttcagtttgcctaatagccttcaatgaaacacggattcttctacttaaaaaaggtaagcctggagaaaataaaactgattactatgcaaga

SEQ ID NO: 15722 - DNA, 703 bp, Homo sapiens
tttgacctgattcatgttgtattagttgtgacattgtctatttcaacatacagatattcatccaaagaagtacttaagtttcatttgggtactttaagctttcattttttctttaagtgactgtttgatttctattatacatcaggcactgtttagcccttggaacttctcaagtgtaccaggtaccttgtattctaatcgagaagacacataaatatggccagtattgggaagatgtagctttttattttttctggatttgagtttttagcttaaaacttaaaatttttttcctgtgaatactcttaaagacaaaatcaggaaaattatacagagttgctaaaattttaggttgaataaagactgtctttattctgactagagttaatattaagaagttgaaaatattgatattaggcatgttacctatatgaacaatttaagatgggaacatgaacttgggatgtttgcagtttggaaactactctgaccaaaactaaactgaatgaatataaattctgacagactgatcttcaccattactgtaacctatttgatagtgaacattttttaatgtagctgggcgtgtgggcatgtgactgtagtcccagcctcttgggaggctgaggcaggggaagataccttgaggccaagagttccagctgcagtgagctatgatcacacctatgaatagccactgtac

SEQ ID NO: 15723 - DNA, 516 bp, Homo sapiens
actacgtaatagtcgacctggatgacttctctttttctacttttgacagtggatatttaccatgctggaacctaaagtacttgtatcctatccagctatgtaaaattttacttttatttgcacactaaaggtaaagctacacacacacagacacacatacacacacatttagataaagctttcattaaattacaacataccatagagattctaaataccatatatgtaatttttcataatgctgatgttgaactgaggtgcccaaaagcaaatacactcactgacccaaccaggaagtgacacattataataaatgttttatttttctttttgcaataaataaaaagatggctgatacaatcagaaactccttgtgcagaagcttacattgagtaggattttgatgagaataaagcaaagtctttctaaggtttttaagtaatgacaaatattcttaaaaaccaatagcttaaaaatcaatagctaaataaccaattattaaaaaccaatagctaa

SEQ ID NO: 15724 - DNA, 301 bp, Homo sapiens
ggttttgtgtttttcacttcaaattgggaagcgattgacttttgtatactaaccttgtatcctgcaagcttactgtaattgcttattagttcctggagttttttttgtcagttctttcagattttctgtgtagacaatcatgtcatctgtgaacaaagatagttttatttcttccttcccattctttaccttttcttattgtgttagctagaacccataacaaatttttagatacgagaaagaaggaaggcattaaggttaagtaaaatgtagtactatcatacatttctttgccacggta

SEQ ID NO: 15725 - DNA, 291 bp, Homo sapiens
aattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagc

SEQ ID NO: 15726 - DNA, 566 bp, Homo sapiens
aaaaaaaaaaaaaaacaaaaaaaaaacttgcttaagaccacatggctaggacgtggtggagtttgttctcaactgttttactgtgttgccttctagcacaggatgctataagaaacttgaagaaatgacaggccaggaagaaaatatttatggtctacacaaaggcctaatacttttactatagcaaatcaatgagaaatgatgaatgatctagtttttttttttattgtgtgaaaggtaatggcaaaatcatgccaaaggtcatgagtaataaaatagtatgcaaattaagatgagccttttcacttatcagaccatcagatattgggatttactaagtgataatatccagtgtggttttgtttgagtaatggtttggtttgtaaatgtctatcagtccagcttttttagagggaaattcagtaaacctgtcgaatgggcttgccagttgatctaaaaatttacccctagtaagtaattctctttataaagctaaatatacaaagatgtcacattgtgatagaaaagtccttccatgtgtgggaaggatcatttaaaaaaaaaat

SEQ ID NO: 15727 - DNA, 5247 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15728 - DNA, 5335 bp, Homo sapiens
cgagactcggtgtctgactgacctttcttttcaccattcaatttatagttccgctcagtggtccccacctcctgaagtctgaccaatcagaagcaccgccattttgacctttcaccaatggaaagacttgggactccctctgggttggactcaacgaagatggagtcttgctacattgcccaggctggtcttgaactgctaggctcaagcagttctcccaccttgacctcccaaagcgctgagattacagaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15729 - DNA, 5893 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccaggtactgccagcccccaccctggcctgcaggtccaggtgccgtgtggcagtgccccgtgggggcgggagccgagtggcagtcgggggaaaggagttccacaaaggactgcaatcgagggcctgacggggctccaaggagcctggaatcttgaccaccacaggtctcctgggcaccatttttctccactgacctgtctgacatatttagtagggagggcagggagctgtcaactcgcttaccacctgtgtctacattcacaggtaaggggtcacctgtgagtctaccttcacaggtaaggggtgaatctctgggaaaggggcatttgttcatagcgtcctgacttgagctgtttttcaccccagagctgccccacgaggccccttccccgcaggcactttccagttggtgaaccgaccaggggcatggccctgcagtcagccccacgggtccgaggaggccggggctgcagaggagccgttccctcctgccggccccgcgtcaccctgcccctgtcgccccacagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccagagatggtatcgctctgtcacctgggctggagtccagtggcgtgatcatagctcactgtagcctccaacccctgggctcaagtgatcctccccactcagcctacccaagcagctggaactacaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15730 - DNA, 3589 bp, Homo sapiens
gccacaggatggctgggccccaggagccacccctcccagtgttggctggactcggctgttactcccatctccctgcatgtccccagcagccaggagatgccacttagactctgggtctctgtcctgtctcgcccactgtagagatgacttttccctctagtgacaaagtggcgagcattgctgatctctttattccattccttaaactttcccgactcccagccctactgggataaaggctgccctggttctggatccagtcgtccaggggagtggccagggctccttcagcagtcaggaattagtgttaggcccagaggggcaagcttcctctcctccatctctcacaaccagccacaaatcacggtggggtctgcgaagagccggggccatggagcagcctgtgtagacggggacctgccctgcatgggcaccccctcactggctgcttcccttggtctccaggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccagagatggtatcgctctgtcacctgggctggagtccagtggcgtgatcatagctcactgtagcctccaacccctgggctcaagtgatcctccccactcagcctacccaagcagctggaactacaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaa

SEQ ID NO: 15731 - DNA, 5460 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcctctgctttgtaaaaaaaaaaccatagaaatgataagaaacattagaacgagtataaaaagtgtggggggcgacacaaaagaatgacaagtaggtgggggggcaagttagtgaaatgtcaacgcataagacagtgagagtgggggttcactaaaacgcggaggatggtaatacaggggggttaggataagagcaggtatacagggggagagagagaaagaagagaaa

SEQ ID NO: 15732 - DNA, 5206 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtaggagccctgtatgacatctgagcgtggtggaggtaggagggttgccagctgcagtgaccctgccacagaggcagggtcagtgcagaggtcgctttggttccgcttccctgggccacagaacggaacacagcataggttctgcagcaggagccgcagtggcaggatggagggtgcgaagggcaaggagtgcactgctgggcattcctggccagccccggccctctggtgcctgcttcctgtgacttcagaaggcaggtggacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcacacaggagcaacaggggggatgagcacacaggtggggatgagcacacaggtggggat

SEQ ID NO: 15733 - DNA, 3688 bp, Homo sapiens
  misc_feature (11)..(11): n is a, c, g, or t
gagctggcgcngtgccctggtggcagtggctgaagtggcggcggcttcggcggctgcggcggctgcaacagcttcgggctcggggttttggcggcggcgccggcgggctaggctgcgcggtgcggaccccggcgcgcggtccgggttgctggggcggcgcgtaagatgcctctaatggaggagtttctgagcagcacccctggcccagtggctttgaaagggagctcaaaccagagactatttcaagccctggatatcatatcctgagggccacaggagaagagaacatggctgtgagtttggatgacgacgtgccgctcatcctgaccttggatgagggtggcagtgccccactggctccctccaacggcctgggccaagaagagctacctagcaaaaatggcggcagctatgccatccacgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacggccctgctgctgctgctgctctccctgtgcgaggcccccgccgtccccgcactccggcttggcatctatgtccacgccaccctggagctgtttgccctgatggtggtagtgtttgaactctgcatgaagttacgctggctgggcctccacaccttcatccggcacaagcggaccatggtcaagacctcggtgctggtggtgcagtttgtcgaggccatcgtggtgttggtacggcagatgtcccatgtgcgggtgacccgagcactgcgctgcattttcctggtggactgtcggtattgcggtggcgtccggcgcaacctgcggcagatcttccagtccctgccgcccttcatggacatcctcctgctgctgctgttcttcatgatcatctttgccatcctcggtttctacttgttctcccctaacccttcagacccctacttcagcaccctggagaacagcatcgtcagtctgtttgtccttctgaccacagccaatttcccagatgtgatgatgccctcctactcccggaacccctggtcctgcgtcttcttcatcgtgtacctctccatcgagctgtatttcatcatgaacctgcttctggctgtggtgttcgacaccttcaatgacattgagaaacgcaagttcaagtctttgctactgcacaagcgaaccgctatccagcatgcctaccgcctgctcatcagccagaggaggcctgccggcatctcctacaggcagtttgaaggcctcatgcgcttctacaagccccggatgagtgccagggagcgctatcttaccttcaaggccctgaatcagaacaacacacccctgctcagcctaaaggacttttacgatatctacgaagttgctgctttgaagtggaaggccaagaaaaacagagagcactggtttgatgagcttcccaggacggcgctcctcatcttcaaaggtattaatatccttgtgaagtccaaggccttccagtatttcatgtacttggtggtggcagtcaacggggtctggatcctcgtggagacatttatgctgaaaggtgggaacttcttctccaagcacgtgccctggagttacctcgtctttctaactatctatggggtggagctgttcctgaaggttgccggcctgggccctgtggagtacttgtcttccggatggaacttgtttgacttctccgtgacagtgttcgccttcctgggactgctggcgctggccctcaacatggagcccttctatttcatcgtggtcctgcgccccctccagctgctgaggttgtttaagttgaaggagcgctaccgcaacgtgctggacaccatgttcgagctgctgccccggatggccagcctgggcctcaccctgctcatcttttactactccttcgccatcgtgggcatggagttcttctgcgggatcgtcttccccaactgctgcaacacgagtacagtggcagatgcctaccgctggcgcaaccacaccgtgggcaacaggaccgtggtggaggaaggctactattatctcaataattttgacaacatcctcaacagctttgtgaccctgtttgagctcacagttgtcaacaactggtacatcatcatggaaggcgtcacctctcagacctcccactggagccgcctctacttcatgaccttttacattgtgaccatggtggtgatgacgatcattgtcgcctttatcctcgaggccttcgtcttccgaatgaactacagccgcaagaaccaggactcggaagttgatggtggcatcacccttgagaaggaaatctccaaagaagagctggttgccgtcctggagctctaccgggaggcacggggggcctcctcggatgtcaccaggctgctggagaccctctcccagatggagagataccagcaacattccatggtgtttctgggacggcgatcaaggaccaagagcgacctgagcctgaagatgtaccaggaggagatccaggagtggtatgaggagcatgccagggagcaagagcagcagcgacaactcagcagcagtgcagcccccgccgcccagcagcccccaggcagccgccagcgctcccagaccgttacctagcccagcgcccgaaagccgtctcttctatgcaataacacaatagtattactctactgcgatgtacggaactgcggtgtgtgtacacatactcacgtatatgcacatatttatatacaggaagaaaaaagacagacaagatggggcttggtttataaccaccttgccctgtcttccttaactccagaagccagtttggtgaggggtgggggtgcggccaccaggtctgagctcttcctactgtggaaggctccagaaggcccttcacaaggagacccctcacctggatccagtcgactgcggggcttgcccctcatgtgggctggcctccatcggccacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttcggggaccagtgcccaggatctaatggaagcggaattggggcaactgggcccatgtggccagagctcagttagccagtgccgggcggccacagattacactgaccaatctcctcccttggctctgcaagcctcccacccagccttctctggcttaacccttgttggcgaaaactcttccacagtggcctccttggggacccagaacccggaggaaggggcatgaggcaggaagtggggccgatgtctgcaacccagaccacttcgtggaatgggctcttgaccaaatccctttttttgcgatttacccgttcaagcaaaacaatgctgtacggttttgtacactggtggtttgtttcctagaaaacccattgtgtctctggatttctagcacattactaaaagagcctctgctttgtaaa
